US012601088B2

(12) United States Patent
Elledge et al.

(10) Patent No.: US 12,601,088 B2
(45) Date of Patent: Apr. 14, 2026

(54) DETECTION OF AN ANTIBODY AGAINST A PATHOGEN

(71) Applicants: The Brigham and Women's Hospital, Inc., Boston, MA (US); President and Fellows of Harvard College, Cambridge, MA (US)

(72) Inventors: Stephen J. Elledge, Brookline, MA (US); Harry B. Larman, San Diego, CA (US); Tomasz Kula, Brookline, MA (US); George Xu, Fremont, CA (US)

(73) Assignees: The Brigham and Women's Hospital, Inc., Boston, MA (US); President and Fellows of Harvard College, Cambridge, MA (US)

( * ) Notice: Subject to any disclaimer, the term of this patent is extended or adjusted under 35 U.S.C. 154(b) by 454 days.

(21) Appl. No.: 17/583,947

(22) Filed: Jan. 25, 2022

(65) Prior Publication Data

US 2022/0251541 A1 Aug. 11, 2022

Related U.S. Application Data

(63) Continuation of application No. 16/073,716, filed as application No. PCT/US2017/015411 on Jan. 27, 2017, now abandoned.

(60) Provisional application No. 62/288,011, filed on Jan. 28, 2016.

(51) Int. Cl.
*C40B 30/04* (2006.01)
*C12N 15/10* (2006.01)

(52) U.S. Cl.
CPC .......... *C40B 30/04* (2013.01); *C12N 15/1037* (2013.01)

(58) Field of Classification Search
None
See application file for complete search history.

(56) References Cited

U.S. PATENT DOCUMENTS

| | | | |
|---|---|---|---|
| 5,492,807 A | 2/1996 | Santi | |
| 2002/0197625 A1 | 12/2002 | Hillman | |
| 2003/0082524 A1 | 5/2003 | Pincus | |
| 2005/0123900 A1 | 6/2005 | Dimitrov et al. | |
| 2013/0149336 A1 | 6/2013 | Hjelle | |

FOREIGN PATENT DOCUMENTS

| | | |
|---|---|---|
| WO | 2011082381 A2 | 7/2011 |
| WO | 2013063366 A2 | 5/2013 |
| WO | 2015095355 A2 | 6/2015 |

OTHER PUBLICATIONS

Castel et al. "Phage display of combinatorial peptide libraries: application to antiviral research." Molecules 16(5):3499-3518 (2011).
De Vlaminck et al., "Temporal response of the human virome to immunosuppression and antiviral therapy" Cell. 155(2013), doi: 10.1016/j.cell.2013.10.034.
EP 17744999.8 Search Report of Jul. 12, 2019, 8 pgs.
(Continued)

*Primary Examiner* — Christian C Boesen
(74) *Attorney, Agent, or Firm* — Nixon Peabody LLP; David S. Resnick; Mark J. FitzGerald

(57) ABSTRACT

Provided herein are methods of detecting an antibody directed against a pathogen and uses thereof.

5 Claims, 46 Drawing Sheets

Specification includes a Sequence Listing.

(56)                    References Cited

OTHER PUBLICATIONS

Gnanasekar et al., "Novel phage display-based subtractive screening to identify vaccine candidates of Brugia malayi", Infect Immun 72(8) 4707-4715 (2004).

Langmead et al. Ultrafast and memory-efficient alignment of short DNA sequences to the human genome Genome Biol, 1-10 (2009).

Larman et al., "Autoantigen discovery with a synthetic human peptidome", Nat Biotechnol 29(6) 535-541 (2011).

Larman et al., "Autoantigen discovery with a synthetic human peptidome", Nat Biotechnol 29(6) 535-541 and pp. 1-2 of online methods (2011).

Larman et al., "PhIP-Seq characterization of autoantibodies from patients with multiple sclerosis, type 1 diabetes and rheumatoid arthritis", J Autoimmun 43: 1-9 (2013).

Meyer et al., "Identification of immunogenic proteins and generation of antibodies against *Salmonella typhimurium* using phage display", BMC Biotechnol 12: 29 (2012).

Meyer et al., "Illumina sequencing library preparation for highly multiplexed target capture and sequencing", Cold Spring Harb Procto 2010(6) (2010).

Vita et al., "The immune epitope database 2.0", Nucleic Acids Res 38(Database issue) D854-D862 (2010).

Xu et al. "Comprehensive serological profiling of human populations using a synthetic human virome" Science 348(6239): aaa0698 1-9 (2015).

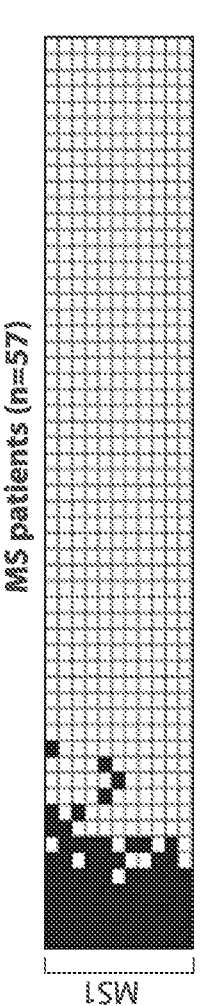

MS patients (n=57)

Peptides
MS1

Fig. 3B

KRTPPAPQNPGGSTQAPQRVVGKSHSGIRM    PAKSRNR
WPGRTVKDEFGGRLDP    PAASRSR    RREPRRAGRWGRG
MLGRSRATATW    PAASRSR    SLAARSLPRSPARPGPND
SMPSLMTGRSAPPS    PALSRSR    PRTGSVQTSPSSTPV
LDHGSPAQENPESEKSS    PAVSRSK    TPTGRFKQTIPS
MSRQSSITFQSGSRRGFSTTSAIT    PAAGRSR    PSSVS
SAAPEPR    PAPGRSR    AMGVLMSKRQTVEQVQKVSLAV
TRSRSHSPS    PSQSRSR    SRSRSQSPSPSPARBKLTRP
AAHASLNPALFSMKMBLAGSNTTASS    PARARGR    PLK
SGGPSSCGGA    PSTSRSR    PSRIPQPVRHHPPVLVSSA
NPGCHPSPTPMLASQRHCRDSAAVCVHVT    PSPSRSL

Fig. 3C bits
4
3
2
1
0
1 2 3 4 5 6 7

Fig. 3D

| Virus | % |
|---|---|
| Epstein-Barr virus | 88.1 |
| Rhinovirus B | 75.2 |
| Human adenovirus C | 74.6 |
| Rhinovirus A | 73.9 |
| Respiratory syncytial virus | 68.0 |
| Influenza A virus | 58.4 |
| Human herpesvirus 6B | 57.1 |
| Herpes simplex virus 1 | 54.1 |
| Cytomegalovirus | 49.8 |
| Influenza B virus | 42.2 |
| Enterovirus C | 37.3 |
| Varicella zoster virus | 24.4 |
| Human adenovirus F | 22.1 |
| Human adenovirus B | 17.5 |
| Herpes simplex virus 2 | 16.5 |
| Human papillomaviruses | 9.9 |

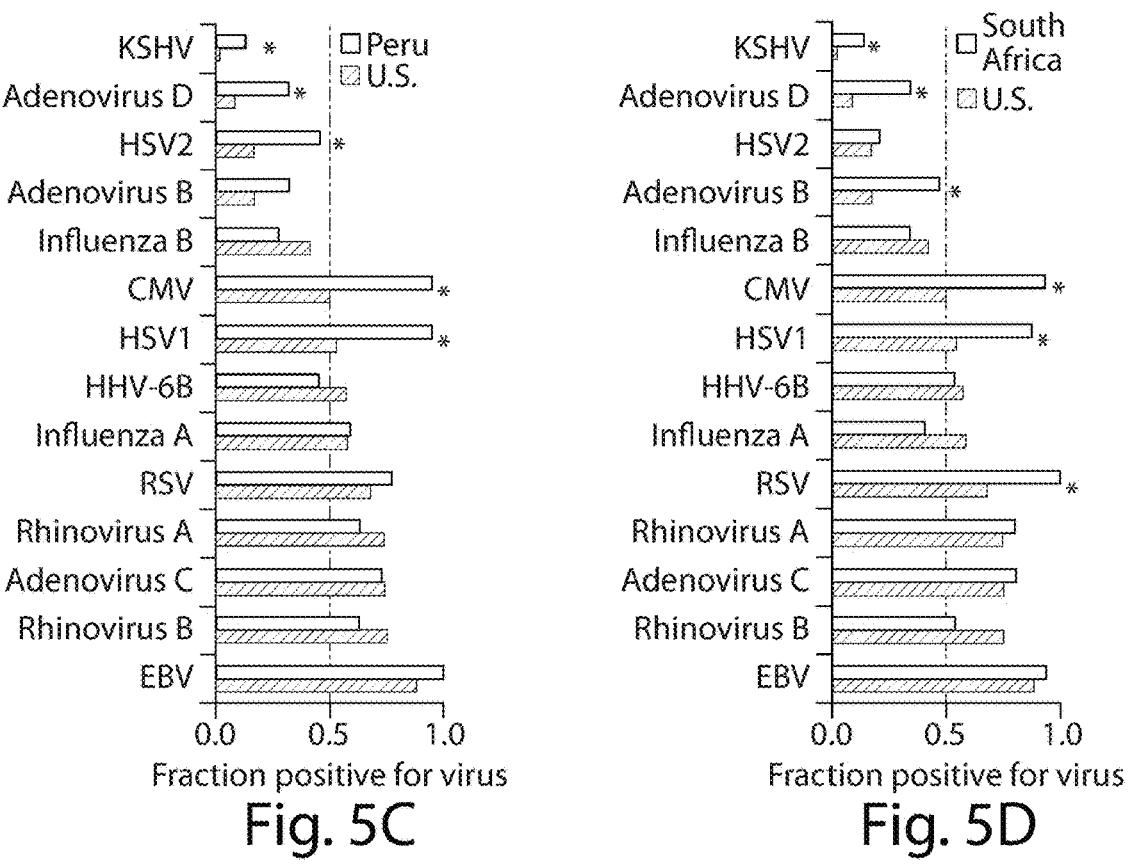
Fig. 5C
Fig. 5D
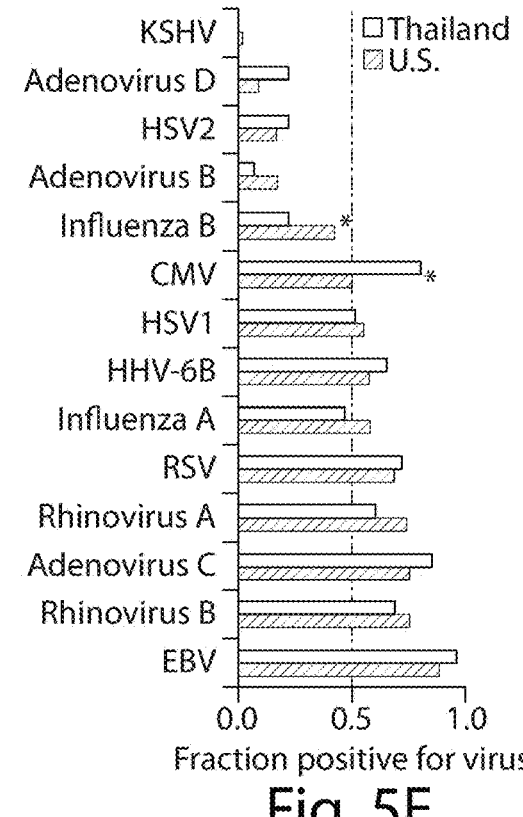
Fig. 5E

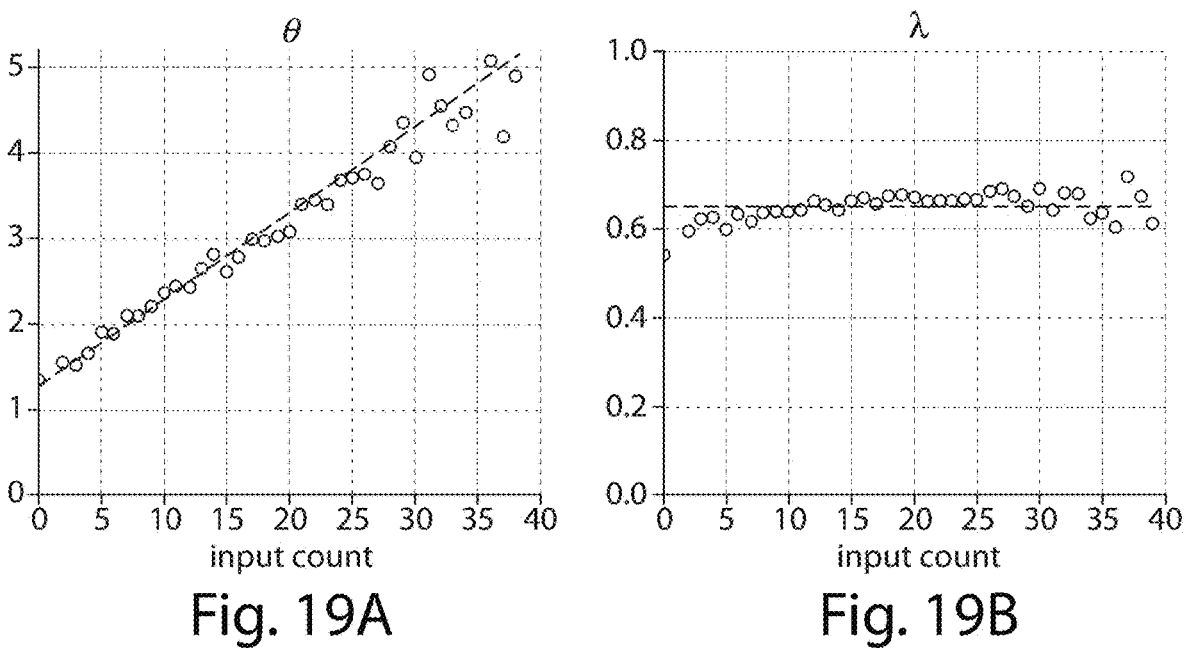
Fig. 19A
Fig. 19B
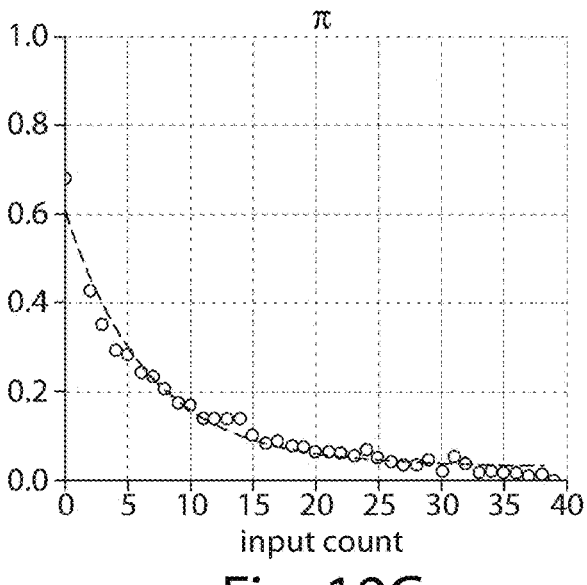
Fig. 19C

FIG. 20

Number of enriched peptides

Serum donors

DETECTION OF AN ANTIBODY AGAINST A PATHOGEN

CROSS REFERENCE TO RELATED APPLICATIONS

This application is Continuation Application that claims benefit under 35 U.S.C. § 120 of U.S. application Ser. No. 16/073,716, filed Jul. 27, 2018, which is a 35 U.S.C. § 371 National Phase Entry Application of International Application No. PCT/US2017/015411, filed Jan. 27, 2017, which designates the U.S. and which claims benefit under 35 U.S.C. § 119(e) of U.S. Provisional Application No. 62/288, 011, filed Jan. 28, 2016, the contents of each of which are incorporated herein by reference in their entireties.

SEQUENCE LISTING

The instant application contains a Sequence Listing which has been submitted electronically in ASCII format and is hereby incorporated by reference in its entirety. Said ASCII copy, created on Feb. 28, 2017, is named 043214-086541-PCT_SL.txt and is 3,153,625 bytes in size.

BACKGROUND

Vertebrate immune systems have evolved sophisticated genetic mechanisms to generate T-cell receptor and antibody repertoires, which are combinatorial libraries of affinity molecules capable of distinguishing between self and non-self. In higher mammals, a delicate balance is struck between metabolism, immune defense against pathogens and autoimmunity, wherein disturbances can result in disease and dysfunction. Amongst such pathogens are viruses. A host's antibody response is crucial for preventing viral infection, or resolution of infection, as antibodies are produced against many epitopes on multiple virus proteins upon viral contact. However, these processes can go awry when, for example, antibodies recognizing viral peptides cross-react with human antigens and contribute to autoimmune disease.

Antibodies bind protein antigens by a variety of mechanisms and knowledge of the processes governing these interactions is improving. For instance, it is now understood that antibody binding surfaces on natively folded proteins tend to be dominated by 'discontinuous' epitopes, which are patches of ~4 to 14 amino acid side chains formed by two or more noncontiguous peptides brought into proximity during protein folding. If a protein is divided into its constituent peptides, antibody affinity can decrease due to the loss of contacts contributed by noncontiguous residues, and the increased entropic costs of binding a free peptide as opposed to the natively constrained peptide. On the other hand, antibodies targeting normally inaccessible epitopes can be generated, such as those that recognize proteolytic cleavage products, misfolded proteins or protein aggregates. In circumstances such as these, full-length, folded proteins may be less sensitive using antigen detection techniques than with shorter peptides. Thus, the degree to which individual peptides interact with a given antibody is difficult to predict, and is expected to vary widely not only amongst different peptides, but also within same or similar peptides introduced into different individuals. In the specific instance of viral antigens, wide-scale, parallel detection is particularly challenging, given highly adaptive evolutionary nature of viruses and comparatively small antigenic signature.

Unfortunately, traditional phage display systems, lack sufficient sensitivity and accuracy to account for such potential antigenic variations. For example, existing techniques for identifying autoantibody targets have relied largely on the expression of fragmented cDNA libraries, such as polypeptides fused to the capsid proteins of bacteriophage. Notable technical limitations of this method include the small fraction of clones expressing coding sequences in the correct reading frame (with a lower bound of 6%), and system bias due to the highly skewed representation of differentially expressed cDNAs.

SUMMARY

Described herein is a proteomic technology applying a phage library that can uniformly express peptide libraries, such as the substantially complete human peptidome, or synthetic representations of a substantially complete set of viral peptides known to infect humans. By combining T7-Pep phage library with high-throughput DNA sequencing, the described systems and methods allow for a wide variety of high-throughput proteomic investigations, with unprecedented speed, precision, and accuracy. For example, the inventors successfully established a complete set of viral peptides containing 79,407 peptide sequences derived from 788 unique viruses, encompassing over 201 species, 67 genera, and 29 families of viruses. This comprehensive library allows simultaneous detection of antiviral antibody response in a subject for both prior and ongoing exposure against virtually all of known viruses capable of infecting humans. Such systems and methods allow a systematic approach for detection of virus infection, mapping of antiviral antibody epitopes, identification of cross-reactive autoimmune epitopes, among a variety of other diagnostic, clinical and technical uses. Thus, provided herein are phage libraries and methods for use including, but not limited to, methods for detecting an antibody against a virus, methods for identifying a viral cause of disease, and methods for improving vaccine design.

One aspect provided herein relates to a method for detecting an antibody against a pathogen in a subject, the method comprising: (a) contacting a reaction sample comprising a display library with a biological sample comprising antibodies, wherein the display library comprises a plurality of peptides derived from a plurality of pathogens, and (b) detecting a peptide bound to at least one antibody, thereby detecting an antibody capable of binding the peptide.

In one embodiment of this aspect and all other aspects described herein, the plurality of pathogens is a plurality of viruses, bacteria or fungi.

In another embodiment of this aspect and all other aspects described herein, the display library is a phage display library.

In another embodiment of this aspect and all other aspects described herein, the antibodies in the reaction sample are immobilized.

In another embodiment of this aspect and all other aspects described herein, the antibodies are immobilized to a solid support adapted for binding IgM, IgA, or IgG subclasses.

In another embodiment of this aspect and all other aspects described herein, the antibodies are immobilized by contacting the display library and antibodies from the biological sample with Protein A and/or Protein G.

In another embodiment of this aspect and all other aspects described herein, the Protein A and/or Protein G are immobilized to a solid support.

3

In another embodiment of this aspect and all other aspects described herein, the method further comprises removing unbound antibody and peptides of the display library.

In another embodiment of this aspect and all other aspects described herein, the plurality of peptides are each less than 100, 200, 300, 500, 500, 600, 700, 800, or 900 amino acids long.

In another embodiment of this aspect and all other aspects described herein, the plurality of peptides are each less than 75 amino acids long.

In another embodiment of this aspect and all other aspects described herein, each peptide of the plurality of peptides comprises a common adapter region appended to the end of the nucleic acid sequence encoding the peptide.

In another embodiment of this aspect and all other aspects described herein, the detection of the at least one peptide comprises a step of lysing the phage and amplifying the DNA.

In another embodiment of this aspect and all other aspects described herein, at least two antibodies are detected. In another embodiment of this aspect and all other aspects described herein, at least two peptides are detected.

In another embodiment of this aspect and all other aspects described herein, the at least two antibodies are detected simultaneously. In another embodiment of this aspect and all other aspects described herein, the at least two peptides are detected simultaneously.

In another embodiment of this aspect and all other aspects described herein, antibodies from the biological samples are immobilized.

In another embodiment of this aspect and all other aspects described herein, the display library comprises at least 2 peptides from Table 4. In other embodiments of this aspect and all other aspects described herein, the display library comprises at least 3, at least 4, at least 5, at least 6, at least 7, at least 8, at least 9, at least 10, at least 15, at least 20, at least 30, at least 40, at least 50, at least 60, at least 70, at least 80, at least 90, at least 100, at least 200, at least 300, at least 400, at least 500, at least 600, at least 700, at least 800, at least 900, at least 1000, at least 2000, at least 3000, at least 4000, at least 5000 peptides or more as selected in any desired combination from Table 4. In some embodiments, the display library comprises all of the peptides in Table 4.

In certain embodiments, the display library can comprise peptides from at least 1 family (e.g., human herpesvirus) or sub-family (e.g., human herpesvirus 5) of related viruses. In other embodiments, the display library can comprise peptides from at least 2 families, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 25, at least 30, at least 35, at least 40, at least 45, or at least 50 peptides from at least 1 family (e.g., human herpesvirus) or sub-family (e.g., human herpesvirus 5) of viruses from Table 4, in any desired combination. In one embodiment, the display library comprises peptides from each of the viral families or subfamilies in Table 4.

Another aspect provided herein relates to a method for identifying a pathogenic component in a disease, the method comprising: (a) obtaining a biological sample from a plurality of subjects having a common disease, wherein the common disease is suspected of having a pathogenic component, (b) separately contacting each sample of a plurality of reaction samples with each biological sample under conditions that allow formation of at least one antibody-peptide complex, wherein the reaction samples each comprise a display library comprising a plurality of peptides derived from a plurality of pathogens, (c) isolating the at least one antibody-peptide complex formed in each reaction sample from unbound phage, (d) correlating at least one peptide in the at least one antibody-peptide complex in each reaction sample to the pathogen from which it is derived, and (e) identifying a pathogen that is significantly enriched in the plurality of subjects with disease compared to subjects without the disease.

In one embodiment of this aspect and all other aspects described herein, the plurality of pathogens is a plurality of viruses, bacteria or fungi.

In another embodiment of this aspect and all other aspects described herein, the display library is a phage display library.

In another embodiment of this aspect and all other aspects described herein, the antibodies in the reaction sample are immobilized.

In another embodiment of this aspect and all other aspects described herein, the antibodies are immobilized to a solid support adapted for binding IgM, IgA, or IgG subclasses.

In another embodiment of this aspect and all other aspects described herein, the antibodies are immobilized by contacting the display library and antibodies from the biological sample with Protein A and/or Protein G.

In another embodiment of this aspect and all other aspects described herein, the Protein A and/or Protein G are immobilized to a solid support.

In another embodiment of this aspect and all other aspects described herein, the plurality of peptides are each less than 100, 200, 300, 400, 500, 600, 700, 800 or 900 amino acids long.

In another embodiment of this aspect and all other aspects described herein, the plurality of peptides are each less than 75 amino acids long.

In another embodiment of this aspect and all other aspects described herein, each peptide of the plurality of peptides comprises a common adapter region appended to the end of the nucleic acid sequence encoding the peptide.

In another embodiment of this aspect and all other aspects described herein, correlating the at least one peptide comprises a step of lysing the phage and amplifying the DNA.

In another embodiment of this aspect and all other aspects described herein, at least two peptides are detected.

In another embodiment of this aspect and all other aspects described herein, the at least two peptides are detected simultaneously.

In another embodiment of this aspect and all other aspects described herein, the common disease comprises disease selected from the group consisting of: Kawasaki Disease, Bell's Palsy, Meniere's Disease, Type I diabetes, juvenile idiopathic arthritis, Chronic Fatigue Syndrome, Gulf War Illness, Myasthenia Gravis, and IgG4 disease.

In another embodiment of this aspect and all other aspects described herein, the method further comprises identifying the epitope to which the antibody binds.

In another embodiment of this aspect and all other aspects described herein, the method further comprises determining whether the antibody cross-reacts with an autoimmune antigen in the subject.

Another aspect provided herein relates to a method for improving vaccine design, the method comprising: (a) obtaining a biological sample from a plurality of subjects exposed to a pathogen, (b) separately contacting each sample of a plurality of reaction samples with each biological sample under conditions that allow formation of at least one antibody-peptide complex, wherein the reaction samples each comprise a display library comprising a plurality of peptides derived from a plurality of pathogens, (c) isolating the at least one antibody-peptide complex formed in each reaction sample from unbound phage, (d) correlating at least one peptide in the at least one antibody-peptide complex in each reaction sample to the pathogen from which it is derived, and (e) identifying an antigenic peptide that is significantly enriched in the plurality of subjects exposed to the pathogen as compared to subjects that have not been exposed to the pathogen for use in designing an improved vaccine.

In one embodiment of this aspect and all other aspects described herein, the plurality of pathogens is a plurality of viruses, bacteria or fungi.

In another embodiment of this aspect and all other aspects described herein, the display library is a phage display library.

In another embodiment of this aspect and all other aspects described herein, the antibodies in the reaction sample are immobilized.

In another embodiment of this aspect and all other aspects described herein, the antibodies are immobilized to a solid support adapted for binding IgM, IgA, or IgG subclasses.

In another embodiment of this aspect and all other aspects described herein, the antibodies are immobilized by contacting the display library and antibodies from the biological sample with Protein A and/or Protein G.

In another embodiment of this aspect and all other aspects described herein, the Protein A and/or Protein G are immobilized to a solid support.

In another embodiment of this aspect and all other aspects described herein, the plurality of peptides are each less than 100 amino acids long.

In another embodiment of this aspect and all other aspects described herein, the plurality of peptides are each less than 75 amino acids long.

In another embodiment of this aspect and all other aspects described herein, each peptide of the plurality of peptides comprises a common adapter region appended to the end of the nucleic acid sequence encoding the peptide.

In another embodiment of this aspect and all other aspects described herein, the detection of the antigenic peptide comprises a step of lysing the phage and amplifying the DNA.

In another embodiment of this aspect and all other aspects described herein, at least two antibodies are detected.

In another embodiment of this aspect and all other aspects described herein, the at least two antibodies are detected simultaneously.

In another embodiment of this aspect and all other aspects described herein, the display library comprises at least 2 peptides from Table 4. In other embodiments of this aspect and all other aspects described herein, the display library comprises at least 3, at least 4, at least 5, at least 6, at least 7, at least 8, at least 9, at least 10, at least 15, at least 20, at least 30, at least 40, at least 50, at least 60, at least 70, at least 80, at least 90, at least 100, at least 200, at least 300, at least 400, at least 500, at least 600, at least 700, at least 800, at least 900, at least 1000, at least 2000, at least 3000, at least 4000, at least 5000 peptides or more as selected in any desired combination from Table 4. In some embodiments, the display library comprises all of the peptides in Table 4.

In certain embodiments, the display library can comprise peptides from at least 1 family (e.g., human herpesvirus) or sub-family (e.g., human herpesvirus 5) of related viruses. In other embodiments, the display library can comprise peptides from at least 2 families, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 25, at least 30, at least 35, at least 40, at least 45, or at least 50 peptides from at least 1 family (e.g., human herpesvirus) or sub-family (e.g., human herpesvirus 5) of viruses from Table 4, in any desired combination. In one embodiment, the display library comprises peptides from each of the viral families or subfamilies in Table 4.

Also provided herein, in another aspect, is a phage library displaying a plurality of viral peptides, wherein the plurality of viral peptides represent a set of peptides from viruses known to infect humans.

In one embodiment of this aspect and all other aspects described herein, the phage library comprises a plurality of viral peptides from at least 3 viruses known to infect humans.

In another embodiment of this aspect and all other aspects described herein, the phage library comprises a plurality of viral peptides from at least 10 viruses known to infect humans.

In another embodiment of this aspect and all other aspects described herein, the phage library comprises a plurality of viral peptides from at least 20 viruses known to infect humans.

In another embodiment of this aspect and all other aspects described herein, the phage library comprises at least 10 peptide sequences.

In another embodiment of this aspect and all other aspects described herein, the phage library comprises at least 20 peptide sequences.

In another embodiment of this aspect and all other aspects described herein, the plurality of peptides are each less than 100 amino acids long.

In another embodiment of this aspect and all other aspects described herein, the plurality of peptides are each less than 75 amino acids long.

In another embodiment of this aspect and all other aspects described herein, each peptide of the plurality of peptides comprises a common adapter region appended to the end of the nucleic acid sequence encoding the peptide.

In another embodiment of this aspect and all other aspects described herein, the plurality of peptides are immunodominant epitopes.

In another embodiment of this aspect and all other aspects described herein, the display library comprises at least 2 peptides from Table 4. In other embodiments of this aspect and all other aspects described herein, the display library comprises at least 3, at least 4, at least 5, at least 6, at least 7, at least 8, at least 9, at least 10, at least 15, at least 20, at least 30, at least 40, at least 50, at least 60, at least 70, at least 80, at least 90, at least 100, at least 200, at least 300, at least 400, at least 500, at least 600, at least 700, at least 800, at least 900, at least 1000, at least 2000, at least 3000, at least 4000, at least 5000 peptides or more as selected in any desired combination from Table 4. In some embodiments, the display library comprises all of the peptides in Table 4.

In certain embodiments, the display library can comprise peptides from at least 1 family (e.g., human herpesvirus) or sub-family (e.g., human herpesvirus 5) of related viruses. In other embodiments, the display library can comprise peptides from at least 2 families, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 25, at least 30, at least 35, at least 40, at least 45, or at least 50 peptides from at least 1 family (e.g., human herpesvirus) or sub-family (e.g., human herpesvirus 5) of viruses from Table 4, in any desired combination. In one embodiment, the display library comprises peptides from each of the viral families or subfamilies in Table 4.

BRIEF DESCRIPTION OF FIGURES

FIGS. 3A-3D Using a library of peptides encoded by the human genome, the Inventors identified an epitope in multiple sclerosis patients known to cross-react with a portion of the EBV BRRF2 protein (FIGS. 3A, 3B) inset, black squares indicates the patient, columns, has a response against the peptide, row, containing the epitope). Using the library of peptides encoded by human viruses, the Inventors also detected strong responses against this epitope, found in two peptides (BRRF2 A and BRRF2 B), in all three of samples from patients with multiple sclerosis who had previously been confirmed to have cross-reacting antibody responses (MS_2430_2, MS2430_1, and MS_5826_1). (FIG. 3C) ClustalW alignment (SEQ ID NOS 22-32, respectively, in order of appearance) is shown along with (FIG. 3D) MEME-generated seven-element motif.

(FIG. 4A) Antibody profile of randomly chosen group of donors to show typical assay results. Each row is a virus, each column is a sample. The label above each chart indicates whether the donors are over 10 years of age or at most 10 years of age. The intensity of each cell indicates the number of peptides from the virus that were significantly enriched by antibodies in the sample. (FIG. 4B) Overlap between enriched peptides detected by VirScan and human B cell epitopes from viruses in IEDB. The entire pink circle represents the 1,715 groups of non-redundant IEDB epitopes that are also present in the VirScan library (out of 1,877 clusters total). The overlap region represents the number of groups with an epitope that is also contained in an enriched peptide detected by VirScan. The purple only region represents the number of non-redundant enriched peptides detected by VirScan that do not contain an IEDB epitope. Data are shown for peptides enriched in at least one and at least two samples. (FIG. 4C) Overlap between enriched peptides detected by VirScan and human B cell epitopes in IEDB from common human viruses. The regions represent the same values as in (FIG. 4B) except only epitopes corresponding to the indicated virus are considered, and only peptides from that virus that were enriched in at least two samples were considered. (FIG. 4D) Distribution of number of viruses detected in each sample. The histogram depicts the frequency of samples binned by the number of virus species detected by VirScan. The mean and median of the distribution are both approximately 11 virus species. (FIG. 4E) Frequently observed virus exposures. The '%' column indicates the percentage of samples that were positive for the virus by VirScan. Known HIV and HCV positive samples were excluded when performing this analysis.

FIGS. 5A-5E show a population stratification of the human virome immune response. The bar graphs depict the differences in exposure to viruses between donors who are (FIG. 5A) children less than ten years of age versus adults over ten years of age, (FIG. 5B) HIV positive versus HIV negative, (FIG. 5C) residing in Peru versus residing in the United States, (FIG. 5D) residing in South Africa versus residing in the United States, and (FIG. 5E) residing in Thailand versus residing in the United States. Asterisks indicate false discovery rate <0.05.

(FIG. 11A) Bar graph of the fractional abundance of each amino acid in the entire virome peptide library or peptides enriched in at least 2 samples. (FIG. 11B) Bar graph of the fractional abundance of each amino acid in peptides enriched in at least 2 samples subtracted by the abundance in the entire library.

FIGS. 19A-19C Zero inflated generalized poisson (ZIGP) parameters regressed on input count (FIG. 19A, theta parameter; FIG. 19B, lambda parameter; FIG. 19C, pi parameter). Each scatter plot depicts the maximum likelihood estimates for the ZIGP parameters as a function of the input count (horizontal axis). Dashed lines are least-squares linear regressions for $\theta$ and $\lambda$, and least-squares exponential regression for $\pi$.

FIG. 20 Proteome-wide detection of antibodies to *Chlamydia trachomatis*. Each box represents the number of peptides from a given protein (listed on the x-axis) enriched by the serum of a given donor (listed on the y-axis).

DETAILED DESCRIPTION

Figure 1A:
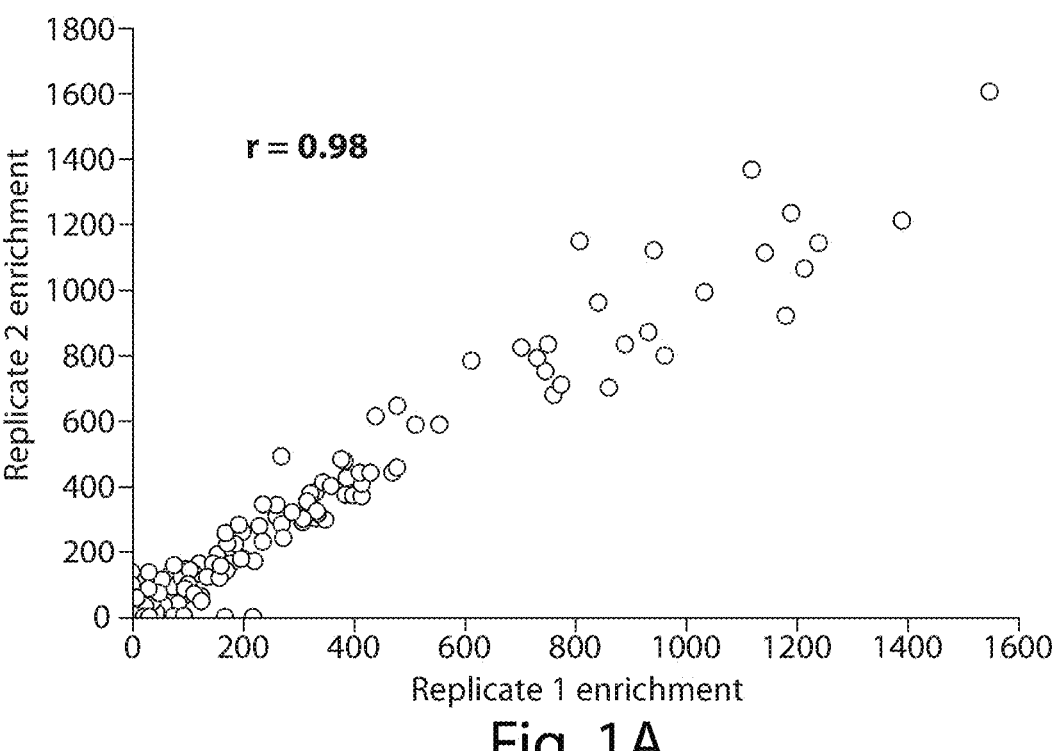
FIGS. 1A-1C show the fold enrichment of each peptide in each of two pull-downs with (FIG. 1A) the same donor serum or (FIG. 1B) the sera of two different donors (FIG. 1C) illustration of process (from Benjamin, et al. Nature Biotechnology 29: 535-541 (2011)).

The inventors have previously deployed programmable microarrays to synthesize oligonucleotides encoding wide sets of peptides, such as the complete human peptidome, coupled with high throughput sequencing to analyze the results after selection. Larman, H. Benjamin, et al. "Autoantigen discovery with a synthetic human peptidome." Nature Biotechnology 29: 535-541 (2011). Described herein is a specific implementation of that approach wherein synthetic representations of a complete set of viral peptides can be generated, such as a set of viral peptides derived from viruses known to infect humans.

One aspect of the present technology is that unlike existing phage display techniques which rely on cDNA, programmable microarrays enable construction of a starting library that is uniformly distributed. The synthetic programmable microarray approach eliminates skewed initial distributions in cDNA libraries resulting from incorrect reading frame or differential gene expression obstacles, which ultimately hamper accurate detection of peptide enrichment. Further, when coupled with high throughput sequencing for selection, the programmable microarray approach compares favorably to traditional Sanger sequencing or microarray hybridization techniques, as high throughput phage immunoprecipitation sequencing (PhIP-Seq) allows sensitive detection for a larger number of library members and with a wider dynamic range.

A key aspect of the present invention is extending the programmable microarray technique to include peptides from the protein sequences of viruses, including those that infect humans. Viruses play an important role in the pathogenesis of various human diseases and antiviral antibody responses can be very strong, essentially providing a persistent, but subtle antibody host signature for detection. Upon viral or other pathogenic exposure, host generated antibodies can neutralize viral particles and stop infection by interfering with virion binding to receptors, blocking uptake into cells, preventing uncoating of the genomes in endosomes, or causing aggregation of virus particles. In some instances, enveloped viruses are lysed when antiviral antibodies and serum complement disrupt membranes. In other instances, non-neutralizing antibodies that bind specifically to virus particles, but do not neutralize infectivity may actually enhance infectivity due to antibodies that interact with receptors on macrophages, resulting in virus-antibody complex being brought into the cell by endocytosis. Viral replication then proceeds, as the antibody does not block infectivity, and this pathway may allow entry into cells which normally do not bear specific virus receptors. Moreover, in some situations, host generated antibodies recognizing viral peptides can cross-react with human self-antigens, contributing to the establishment and progression of autoimmune disease. Each of these mechanisms plays a vital role in accounting for the potentiality of disease and/or dysfunction caused by viral exposure.

While the disclosure specifically recites phage display libraries, it is specifically contemplated herein that other display libraries can be used with the methods and assays described herein including, but not limited to, a yeast display library, a bacterial display library, a retroviral display library, a ribosome display library or an mRNA display library. It is within the skills of one of ordinary skill in the art to apply the methods and assays exemplified herein using a phage display library to the use of a different type of display library.

Definitions

As used herein, the term "display library" refers to a library comprising a plurality of peptides derived from a plurality of pathogens that are displayed on the surface of a virus or cell e.g., bacteriophage, yeast, or bacteria. Methods for using such phage, yeast or bacterial display libraries are well known to those of skill in the art.

As used herein, the term "common disease" refers to a subset of subjects having the same or substantially similar diseases; that is, the subjects have the same disease "in common."

As used herein, the term "antibody-peptide complex" refers to a complex formed when an antibody recognizes an epitope on a peptide and binds to the epitope under low or normal stringent conditions. It will be appreciated that an antibody-peptide complex can dissociate under high stringent conditions, such as low or high pH, or high temperatures.

As used herein, the term "to the pathogen from which it is derived" refers to a step of correlating or mapping at least one peptide in an antibody-peptide complex to a sequence in the known sequences of the viruses, thereby identifying the pathogen that comprises the peptide sequence.

As used herein, the term "enriched" indicates that peptides from a given pathogen are represented at a higher proportion in a population of subjects having a common disease or exposed to a pathogen as compared to the general population or a population lacking the common disease or pathogen exposure. In some embodiments, the peptides from a given pathogen in the population of subjects having a common disease are enriched by at least 10% as compared to the general population. In other embodiments, the peptides for a given pathogen are enriched by at least 20%, at least 30%, at least 40%, at least 50%, at least 60%, at least 70%, at least 80%, at least 90%, at least 95%, at least 99%, at least 1-fold, at least 2-fold, at least 5-fold, at least 10-fold, at least 25-fold, at least 50-fold, at least 100-fold, at least 1000-fold, or more, compared to the general population.

As used herein the term "oligonucleotide primers" refers to nucleic acid sequences that are 5 to 100 nucleotides in length, preferably from 17 to 45 nucleotides, although primers of different length are of use. Primers for synthesizing cDNAs are preferably 10-45 nucleotides, while primers for amplification are preferably about 17-25 nucleotides. Primers useful in the methods described herein are also designed to have a particular melting temperature (Tm) by the method of melting temperature estimation. Commercial programs, including OLIGO™, Primer Design and programs available on the internet, including PRIMER3 and OLIGO CALCULATOR can be used to calculate a Tm of a polynucleotide sequence useful according to the methods and assays described herein. Preferably, the Tm of an amplification primer useful according to the invention, as calculated for example by OLIGO CALCULATOR, is preferably between about 45 and 65° C. In other embodiments, the Tm of the amplification primer is between about 50 and 60° C.

As used herein, the term "sample" refers to a biological material which is isolated from its natural environment and contains at least one antibody. A sample according to the methods described herein, may consist of purified or isolated antibody, or it may comprise a biological sample such as a tissue sample, a biological fluid sample, or a cell sample comprising an antibody. A biological fluid includes, but is not limited to, blood, plasma, sputum, urine, cerebrospinal fluid, lavages, and leukophoresis samples, for example.

As used herein the term "adapter sequence" refers to a nucleic acid sequence appended to a nucleic acid sequence encoding a phage-displayed peptide. In one embodiment, the identical adaptor sequence is appended to the end of each phage-displayed peptide in the phage display library; that is, the adaptor sequence is a common sequence on each nucleic acid of the plurality of nucleic acids encoding a peptide in the phage display library. In one embodiment, the adaptor sequence is of sufficient length to permit annealing of a common PCR primer. For example, adaptor sequences useful with the methods described herein are preferably heterologous or artificial nucleotide sequences of at least 15, and preferably 20 to 30 nucleotides in length. An adaptor sequence as described herein can be, but is not necessarily random.

As used herein, the term "comprising" means that other elements can also be present in addition to the defined elements presented. The use of "comprising" indicates inclusion rather than limitation.

The term "consisting of" refers to compositions, methods, and respective components thereof as described herein, which are exclusive of any element not recited in that description of the embodiment.

As used herein the term "consisting essentially of" refers to those elements required for a given embodiment. The term permits the presence of elements that do not materially affect the basic and novel or functional characteristic(s) of that embodiment of the invention.

Pathogens

Provided herein are phage display libraries that comprise a plurality of peptides derived from one or more pathogens.

As used herein the term "pathogen" refers to an organism, including a microorganism, which causes disease in another organism (e.g., animals and plants) by directly infecting the other organism, or by producing agents that causes disease in another organism (e.g., bacteria that produce pathogenic toxins and the like). As used herein, pathogens include, but are not limited to bacteria, protozoa, fungi, nematodes, viroids and viruses, or any combination thereof, wherein each pathogen is capable, either by itself or in concert with another pathogen, of eliciting disease in vertebrates including but not limited to mammals, and including but not limited to humans. As used herein, the term "pathogen" also encompasses microorganisms which may not ordinarily be pathogenic in a non-immunocompromised host. Specific nonlimiting examples of viral pathogens include Herpes simplex virus (HSV)1, HSV2, Epstein Barr virus (EBV), cytomegalovirus (CMV), human Herpes virus (HHV) 6, HHV7, HHV8, Varicella zoster virus (VZV), hepatitis C, hepatitis B, adenovirus, Eastern Equine Encephalitis Virus (EEEV), West Nile virus (WNE), JC virus (JCV) and BK virus (BKV).

As used herein, the term "microorganism" includes prokaryotic and eukaryotic microbial species from the Domains of Archaea, Bacteria and Eucarya, the latter including yeast and filamentous fungi, protozoa, algae, or higher Protista. The terms "microbial cells" and "microbes" are used interchangeably with the term microorganism.

"Bacteria", or "Eubacteria", refers to a domain of prokaryotic organisms. Bacteria include at least 11 distinct groups as follows: (1) Gram-positive (gram+) bacteria, of which there are two major subdivisions: (i) high G+C group (Actinomycetes, Mycobacteria, *Micrococcus*, others) (ii) low G+C group (*Bacillus, Clostridia, Lactobacillus*, Staphylococci, Streptococci, Mycoplasmas); (2) Proteobacteria, e.g., Purple photosynthetic+non-photosynthetic Gram-negative bacteria (includes most "common" Gram-negative bacteria); (3) Cyanobacteria, e.g., oxygenic phototrophs; (4) Spirochetes and related species; (5) Planctomyces; (6) *Bacteroides*, Flavobacteria; (7) *Chlamydia*; (8) Green sulfur bacteria; (9) Green non-sulfur bacteria (also anaerobic phototrophs); (10) Radioresistant micrococci and relatives; (11) *Thermotoga* and Thermosipho thermophiles.

"Gram-negative bacteria" include cocci, nonenteric rods, and enteric rods. The genera of Gram-negative bacteria include, for example, *Neisseria, Spirillum, Pasteurella, Brucella, Yersinia, Francisella, Haemophilus, Bordetella, Escherichia, Salmonella, Shigella, Klebsiella, Proteus, Vibrio, Pseudomonas, Bacteroides, Acetobacter, Aerobacter, Agrobacterium, Azotobacter, Spirilla, Serratia, Vibrio, Rhizobium, Chlamydia, Rickettsia, Treponema*, and *Fusobacterium*.

"Gram-positive bacteria" include cocci, nonsporulating rods, and sporulating rods. The genera of Gram-positive bacteria include, for example, *Actinomyces, Bacillus, Clostridium, Corynebacterium, Erysipelothrix, Lactobacillus, Listeria, Mycobacterium, Myxococcus, Nocardia, Staphylococcus, Streptococcus*, and *Streptomyces*.

The methods described herein can be used to generate a phage display library comprising peptides from pathogens including, but not limited to pathogens from any of the following genera of viruses: Adenoviridae, Alfamovirus, Allexivirus, Allolevivirus, Alphac-yptovirus, Alphaherpesvirinae, Alphanodavirus, Alpharetrovirus, Alphavirus, Aphthovirus, Apscaviroid, Aquabirnavirus, Aquareovirus, Arenaviridae, Arenavirus, Arteriviridae, Arterivirus, Ascoviridae, Ascovirus, Asfarviridae, Asfivirus, Astroviridae, Astrovirus, Aureusvirus, Avenavirus, Aviadenovirus, Avibirnavirus, Avihepadnavirus, Avipoxvirus, Avsunviroid, Avsunviroidae, Baculoviridae, Badnavirus, Barnaviridae, Barnavirus, Bdellomicrovirus, Begomovirus, Benyvirus, Betacryptovirus, Betaherpesvirinae, Betanodavirus, Betaretrovirus, Betatetravirus, Birnaviridae, Bornaviridae, Bornavirus, Bracovirus, Brevidensovirus, Bromoviridae, Bromovirus, Bunyaviridae, Bunyavirus, Bymovirus, "c2-like viruses," Caliciviridae, Capillovirus, Capripoxvirus, Cardiovirus, Carlavirus, Carmovirus, "Cassava vein mosaic-like viruses," Caulimoviridae, Caulimovirus, Chlamydiamicrovirus, Chloriridovirus, Chlorovirus, Chordopoxyirinae, Chrysovirus, Circoviridae, Circovirus, Closteroviridae, Closterovirus, Cocadviroid, Coleviroid, Coltivirus, Comoviridae, Comovirus, Coronaviridae, Coronavirus, Corticoviridae, Corticovirus, "Cricket paralysis-like viruses," Crinivirus, Cucumovirus, Curtovirus, Cypovirus, Cystoviridae, Cystovirus, Cytomegalovirus, Cytorhabdovirus, Deltarelrovirus, Deltavirus, Densovirinae, Densovirus, Dependovirus, Dianthovirus, "Ebola-like viruses," Enamovirus, Enterovirus, Entomobirnavirus, Entomopoxyirinae, Entomopoxvirus A, Entomopoxvirus B, Entomopoxvirus C, Ephemerovirus, Epsilonretrovirus, Errantivirus, Erythrovirus, Fabavirus, Fijivirus, Filoviridae, Flaviviridae, Flavivirus, Foveavirus, Furovirus, Fuselloviridae, Fusellovirus, Gammaherpesvirinae, Gammaretrovirus, Geminiviridae, Giardiavirus, Granulovirus, Hantavirus, Hemivirus, Hepacivirus, Hepadnaviridae, "Hepatitis E-like viruses," Hepatovirus, Herpesviridae, Hordeivirus, Hostuviroid, Hypoviridae, Hypovirus, Ichnovirus, "Ictalurid herpes-like viruses," Idaeovirus, Ilarvirus, "Infectious laryngotracheitis-like viruses," Influenzavirus A, Influenzavirus B, Influenzavirus C, Inoviridae, Inovirus, Ipomovirus, Iridoviridae, Iridovirus, Iteravirus, "L5-like viruses," Lagovirus, "-like viruses," Leishmaniavirus, Lentivirus, Leporipoxvirus, Leviviridae, Levivirus, Lipothrixviridae, Lipothrixvirus, Luteoviridae, Luteovirus, Lymphocryptovirus, Lymphocystivirus, Lyssavirus, Machlomovirus, Macluravirus, Marafivirus, "Marburg-like viruses," "Marek's disease-like viruses," Mastadenovirus, Mastrevirus, Metapneumovirus, Metaviridae, Metavirus, Microviridae, Microvirus, Mitovirus, Molluscipoxvirus, Morbillivirus, "Mu-like viruses," Muromegalovirus, Myoviridae, Nairovirus, Nanovirus, Narnaviridae, Narnavirus, Necrovirus, Nepovirus, Nodaviridae, "Norwalk-like viruses," Novirhabdovirus, Nucleopolyhedrovirus, Nucleorhabdovirus, Oleavirus, Omegatetravirus, Ophiovirus, Orbivirus, Orthohepadnavirus, Orthomyxoviridae, Orthopoxvirus, Orthoreovirus, Oryzavirus, Ourmiavirus, "P1-like viruses," "P2-like viruses," "P22-like viruses," Panicovirus, Papillomaviridae, Papillomavirus, Paramyxoviridae, Paramyxovirinae, Parapoxvirus, Parechovirus, Partitiviridae, Partitivirus, Parvoviridae, Parvovirinae, Parvovirus, Pecluvirus, Pelamoviroid, Pestivirus, "*Petunia* vein clearing-like viruses," Phaeovirus, "-29-like viruses," "-H-like viruses," Phlebovirus, Phycodnaviridae, Phytoreovirus, Picornaviridae, Plasmaviridae, Plasmavirus, Plectrovirus, Pneumovirinae, Pneumovirus, Podoviridae, Polerovirus, Polydnaviridae, Polyomaviridae, Polyomavirus, Pomovirus, Pospiviroid, Pospiviroidae, Potexvirus, Potyviridae, Potyvirus, Poxyiridae, Prasinovirus, Prions, Prymnesiovirus, Pseudoviridae, Pseudovirus, "MI-like viruses", Ranavirus, Reoviridae, Respirovirus, Retroviridae, Rhabdoviridae, Rhadinovirus, Rhinovirus, Rhizidiovirus, "Rice tungro bacilhform-like viruses," Roseolovirus, Rotavirus, Rubivirus, Rubulavirus, Rudiviridae, Rudivirus, Rymovirus, "Sapporo-like viruses," Satellites, Sequiviridae, Sequivirus, Simplexvirus, Siphoviridae, Sobermovirus, "Soybean chlorotic mottle-like viruses," Spiromicrovirus, "SP01-like viruses," Spumavirus, Suipoxvirus, "*Sulfolobus* SNDV-like viruses," "Ti-like viruses," "T4-like viruses," "T5-like viruses," "T7-like viruses," Tectiviridae, Tectivirus, Tenuivirus, Tetraviridae, Thogotovirus, Tobamovirus, Tobravirus, Togaviridae, Tombusviridae, Tombusvirus, Torovirus, Tospovirus, Totiviridae, Totivirus, Trichovirus, Tritimovirus, Tymovirus, Umbravirus, Varicellovirus, Varicosavirus, Vesiculovirus, Vesivirus, Viroids, Vitivirus, Wakavirus, and Yatapoxvirus.

The methods described herein can be used to generate a phage display library comprising peptides derived from pathogens including, but not limited to, pathogens from any of the following genera of the domain of Bacteria (or Eubacteria): *Abiotrophia, Acetitomaculum, Acetivibrio, Acetoanaerobium, Acetobacter, Acetobacterium, Acetofilamentum, Acetogenium, Acetohalobium, Acetomicrobium, Acetonema, Acetothermus, Acholeplasma, Achromatium, Achromobacter, Acidaminobacter, Acidaminococcus, Acidimicrobium, Acidiphilium, Acidisphaera, Acidithiobacillus, Acidobacterium, Acidocella, Acidomonas, Acidothermus, Acidovorax, Acinetobacter, Acrocarpospora, Actinoalloteichus, Actinobacillus, Actinobaculum, Actinobispora, Actinocorallia, Actinokineospora, Actinomadura, Actinomyces, Actinoplanes, Actinopolymorpha, Actinopolyspora, Actinopycnidium, Actinosporangium, Actinosynnema, Aegyptianella, Aequorivita, Aerococcus, Aeromicrobium, Aeromonas, Afipia, Agitococcus, Agreia, Agrobacterium, Agrococcus, Agromonas, Agromyces, Ahrensia, Albibacter, Albidovulum, Alcaligenes, Alcalilimnicola, Alcanivorax, Algoriphagus, Alicycliphilus, Alicyclobacillus, Alishewanella, Alistipes, Alkalibacterium, Alkalilimnicola, Alkaliphilus, Alkalispirillum, Alkanindiges, Allisonella, Allochromatium, Allofustis, Alloiococcus, Allomonas, Allorhizobium, Alterococcus, Alteromonas, Alysiella, Amaricoccus, Aminobacter, Aminobacterium, Aminomonas, Ammonmfex, Ammoniphilus, Amoebobacter, Amorphosphorangium, Amphibacillus, Ampullariella, Amycolata, Amycolatopsis, Anaeroarcus, Anaerobacter, Anaerobaculum, Anaerobiospirillum, Anaerobranca, Anaerococcus, Anaerofilum, Anaeroglobus, Anaerolinea, Anaeromusa, Anaeromyxobacter, Anaerophaga, Anaeroplasma, Anaerorhabdus, Anaerosinus, Anaerostipes, Anaerovibrio, Anaerovorax, Anaplasma, Ancalochloris, Ancalomicrobium, Ancylo-*

*bacter, Aneurinibacillus, Angiococcus, Angulomicrobium, Anoxybacillus, Anoxynatronum, Antarctobacter, Aquabacter, Aquabacterium, Aquamicrobium, Aquaspirillum, Aquifex, Arachnia, Arcanobacterium, Archangium, Arcobacter, Arenibacter, Arhodomonas, Arsenophonus, Arthrobacter, Asaia, Asanoa, Asteroleplasma, Asticcacaulis, Atopobacter, Atopobium, Aurantimonas, Aureobacterium, Azoarcus, Azomonas, Azomonotrichon, Azonexus, Azorhizobium, Azorhizophilus, Azospira, Azospirillum, Azotobacter, Azovibrio, Bacillus, Bacterionema, Bacteriovorax, Bacteroides, Bactoderma, Balnearium, Balneatrix, Bartonella, Bdellovibrio, Beggiatoa, Beyerinckia, Beneckea, Bergeyella, Beutenbergia, Bifidobacterium, Bilophila, Blastobacter, Blastochloris, Blastococcus, Blastomonas, Blattabacterium, Bogoriella, Bordetella, Borrelia, Bosea, Brachybacterium, Brachymonas, Brachyspira, Brackiella, Bradyrhizobium, Branhamella, Brenneria, Brevibacillus, Brevibacterium, Brevinema, Brevundimonas, Brochothrix, Brucella, Brumimicrobium, Buchnera, Budvicia, Bulleidia, Burkholderia, Buttiauxella, Butyrivibrio, Caedibacter, Caenibacterium, Calderobacterium, Caldicellulosiruptor, Caldilinea, Caldimonas, Caldithrix, Caloramator, Caloranaerobacter, Calymmatobacterium, Caminibacter, Caminicella, Campylobacter, Capnocytophaga, Capsularis, Carbophilus, Carboxydibrachium, Carboxydobrachium, Carboxydocella, Carboxydothermus, Cardiobacterium, Carnimonas, Carnobacterium, Caryophanon, Caseobacter, Catellatospora, Catenibacterium, Catenococcus, Catenuloplanes, Catonella, Caulobacter, Cedecea, Cellulomonas, Cellulophaga, Cellulosimicrobium, Cellvibrio, Centipeda, Cetobacterium, Chainia, Chelatobacter, Chelatococcus, Chitinophaga, Chlamydia, Chlamydophila, Chlorobaculum, Chlorobium, Chloroflexus, Chloroherpeton, Chloronema, Chondromyces, Chromatium, Chromobacterium, Chromohalobacter, Chryseobacterium, Chryseomonas, Chrysiogenes, Citricoccus, Citrobacter, Clavibacter, Clevelandina, Clostridium, Cobetia, Coenonia, Collinsella, Colwellia, Comamonas, Conexibacter, Conglomeromonas, Coprobacillus, Coprococcus, Coprothermobacter, Coriobacterium, Corynebacterium, Couchioplanes, Cowdria, Coxiella, Craurococcus, Crenothrix, Crinalium (not validly published), Cristispira, Croceibacter, Crocinitomix, Crossiella, Cryobacterium, Cryomorpha, Cryptobacterium, Cryptosporangium, Cupriavidus, Curtobacterium, Cyclobacterium, Cycloclasticus, Cystobacter, Cytophaga, Dactylosporangium, Dechloromonas, Dechlorosoma, Deferribacter, Defluvibacter, Dehalobacter, Dehalospirillum, Deinobacter, Deinococcus, Deleya, Delftia, Demetria, Dendrosporobacter, Denitrobacterium, Denitrovibrio, Dermabacter, Dermacoccus, Dermatophilus, Derxia, Desemzia, Desulfacinum, Desulfitobacterium, Desulfobacca, Desulfobacter, Desulfobacterium, Desulfobacula, Desulfobulbus, Desulfocapsa, Desulfocella, Desulfococcus, Desulfofaba, Desulfofrigus, Desulfofustis, Desulfohalobium, Desulfomicrobium, Desulfomonas, Desulfomonile, Desulfomusa, Desulfonatronovibrio, Desulfonatronum, Desulfonauticus, Desulfonema, Desulfonispora, Desulforegula, Desulforhabdus, Desulforhopalus, Desulfosarcina, Desulfospira, Desulfosporosinus, Desulfotalea, Desulfotignum, Desulfotomaculum, Desulfovibrio, Desulfovirga, Desulfurella, Desulfurobacterium, Desulfuromonas, Desulfuromusa, Dethiosulfovibrio, Devosia, Dialister, Diaphorobacter, Dichelobacter, Dichotomicrobium, Dictyoglomus, Dietzia, Diplocalyx, Dolosicoccus, Dolosigranulum, Dorea, Duganella, Dyadobacter, Dysgonomonas, Ectothiorhodospira, Edwardsiella, Eggerthella, Ehrlichia, Eikenella, Elytrosporangium, Empedobacter, Enhydrobacter, Enhygromyxa,*

Ensifer, Enterobacter, Enterococcus, Enterovibrio, Entomoplasma, Eperythrozoon, Eremococcus, Erwinia, Erysipelothrix, Erythrobacter, Erythromicrobium, Erythromonas, Escherichia, Eubacterium, Ewingella, Excellospora, Exiguobacterium, Facklamia, Faecalibacterium, Faenia, Falcivibrio, Ferribacterium, Ferrimonas, Fervidobacterium, Fibrobacter, Filibacter, Filifactor, Filobacillus, Filomicrobium, Finegoldia, Flammeovirga, Flavimonas, Flavobacterium, Flectobacillus, Flexibacter, Flexistipes, Flexithrix, Fluoribacter, Formivibrio, Francisella, Frankia, Frateuria, Friedmanniella, Frigoribacterium, Fulvimarina, Fulvimonas, Fundibacter, Fusibacter, Fusobacterium, Gallibacterium, Gallicola, Gallionella, Garciella, Gardnerella, Gelidibacter, Gelria, Gemella, Gemmata, Gemmatimonas, Gemmiger, Gemmobacter, Geobacillus, Geobacter, Geodermatophilus, Georgenia, Geothrix, Geotoga, Geovibrio, Glaciecola, Globicatella, Gluconacetobacter, Gluconoacetobacter, Gluconobacter, Glycomyces, Gordonia, Gordonia, Gracilibacillus, Grahamella, Granulicatella, Grimontia, Haemobartonella, Haemophilus, Hafnia, Hahella, Halanaerobacter, Halanaerobium, Haliangium, Haliscomenobacter, Hallella, Haloanaerobacter, Haloanaerobium, Halobacillus, Halobacteroides, Halocella, Halochromatium, Haloincola, Halomicrobium, Halomonas, Halonatronum, Halorhodospira, Halospirulina, Halothermothrix, Halothiobacillus, Halovibrio, Helcococcus, Heliobacillus, Helicobacter, Heliobacterium, Heliophilum, Heliorestis, Heliothrix, Herbaspirillum, Herbidospora, Herpetosiphon, Hippea, Hirschia, Histophilus, Holdemania, Hollandina, Holophaga, Holospora, Hongia, Hydrogenobacter, Hydrogenobaculum, Hydrogenophaga, Hydrogenophilus, Hydrogenothermus, Hydrogenovibrio, Hymenobacter, Hyphomicrobium, Hyphomonas, Ideonella, Idiomarina, Ignavigranum, Ilyobacter, Inquilinus, Intrasporangium, Iodobacter, Isobaculum, Isochromatium, Isosphaera, Janibacter, Jannaschia, Janthinobacterium, Jeotgalibacillus, Jeotgalicoccus, Johnsonella, Jonesia, Kerstersia, Ketogulonicigenium, Ketogulonigenium, Kibdelosporangium, Kineococcus, Kineosphaera, Kineosporia, Kingella, Kitasatoa, Kitasatospora, Kitasatosporia, Klebsiella, Kluyvera, Knoellia, Kocuria, Koserella, Kozakia, Kribbella, Kurthia, Kutzneria, Kytococcus, Labrys, Lachnobacterium, Lachnospira, Lactobacillus, Lactococcus, Lactosphaera, Lamprobacter, Lamprocystis, Lampropedia, Laribacter, Lautropia, Lawsonia, Lechevalieria, Leclercia, Legionella, Leifsonia, Leisingera, Leminorella, Lentibacillus, Lentzea, Leptonema, Leptospira, Leptospirillum, Leptothrix, Leptotrichia, Leucobacter, Leuconostoc, Leucothrix, Levinea, Lewinella, Limnobacter, Limnothrix, Listeria, Listonella, Lonepinella, Longispora, Lucibacterium, Luteimonas, Luteococcus, Lysobacter, Lyticum, Macrococcus, Macromonas, Magnetospirillum, Malonomonas, Mannheimia, Maricaulis, Marichromatium, Marinibacillus, Marinilabilia, Marinilactibacillus, Marinithermus, Marinitoga, Marinobacter, Marinobacterium, Marinococcus, Marinomonas, Marinospirillum, Marmoricola, Massilia, Megamonas, Megasphaera, Meiothermus, Melissococcus, Melittangium, Meniscus, Mesonia, Mesophilobacter, Mesoplasma, Mesorhizobium, Methylarcula, Methylobacillus, Methylobacter, Methylobacterium, Methylocaldum, Methylocapsa, Methylocella, Methylococcus, Methylocystis, Methylomicrobium, Methylomonas, Methylophaga, Methylophilus, Methylopila, Methylorhabdus, Methylosarcina, Methylosinus, Methylosphaera, Methylovorus, Micavibrio, Microbacterium, Microbispora, Microbulbifer, Micrococcus, Microcyclus, Microcystis, Microellobosporia, Microlunatus, Micromonas, Micromonospora, Micropolyspora, Micropruina, Microscilla, Microsphaera, Microtetraspora, Microvirga, Microvirgula, Mitsuokella, Mobiluncus, Modestobacter, Moellerella, Mogibacterium, Moorella, Moraxella, Morganella, Moritella, Morococcus, Muricauda, Muricoccus, Mycetocola, Mycobacterium, Mycoplana, Mycoplasma, Myroides, Myxococcus, Nannocystis, Natroniella, Natronincola, Natronoincola, Nautilia, Neisseria, Neochlamydia, Neorickettsia, Neptunomonas, Nesterenkonia, Nevskia, Nitrobacter, Nitrococcus, Nitrosococcus, Nitrosolobus, Nitrosomonas, Nitrosospira, Nitrospina, Nitrospira, Nocardia, Nocardioides, Nocardiopsis, Nonomuraea, Nonomuria, Novosphingobium, Obesumbacterium, Oceanicaulis, Oceanimonas, Oceanisphaera, Oceanithermus, Oceanobacillus, Oceanobacter, Oceanomonas, Oceanospirillum, Ochrobactrum, Octadecabacter, Oenococcus, Oerskovia, Okibacterium, Oleiphilus, Oleispira, Oligella, Oligotropha, Olsenella, Opitutus, Orenia, Oribaculum, Orientia, Ornithinicoccus, Ornithinimicrobium, Ornithobacterium, Oscillochloris, Oscillospira, Oxalicibacterium, Oxalobacter, Oxalophagus, Oxobacter, Paenibacillus, Pandoraea, Pannonibacter, Pantoea, Papillibacter, Parachlamydia, Paracoccus, Paracraurococcus, Paralactobacillus, Paraliobacillus, Parascardovia, Parvularcula, Pasteurella, Pasteuria, Paucimonas, Pectinatus, Pectobacterium, Pediococcus, Pedobacter, Pedomicrobium, Pelczaria, Pelistega, Pelobacter, Pelodictyon, Pelospora, Pelotomaculum, Peptococcus, Peptoniphilus, Peptostreptococcus, Persephonella, Persicobacter, Petrotoga, Pfennigia, Phaeospirillum, Phascolarctobacterium, Phenylobacterium, Phocoenobacter, Photobacterium, Photorhabdus, Phyllobacterium, Pigmentiphaga, Pilimelia, Pillotina, Pimelobacter, Pirella, Pirellula, Piscirickettsia, Planctomyces, Planktothricoides, Planktothrix, Planobispora, Planococcus, Planomicrobium, Planomonospora, Planopolyspora, Planotetraspora, Plantibacter, Pleisomonas, Plesiocystis, Plesiomonas, Polaribacter, Polaromonas, Polyangium, Polynucleobacter, Porphyrobacter, Porphyromonas, Pragia, Prauserella, Prevotella, Prochlorococcus, Prochloron, Prochlorothrix, Prolinoborus, Promicromonospora, Propionibacter, Propionibacterium, Propionicimonas, Propioniferax, Propionigenium, Propionimicrobium, Propionispira, Propionispora, Propionivibrio, Prosthecobacter, Prosthecochloris, Prosthecomicrobium, Proteus, Protomonas, Providencia, Pseudaminobacter, Pseudoalteromonas, Pseudoamycolata, Pseudobutyrivibrio, Pseudocaedibacter, Pseudomonas, Pseudonocardia, Pseudoramibacter, Pseudorhodobacter, Pseudospirillum, Pseudoxanthomonas, Psychrobacter, Psychroflexus, Psychromonas, Psychroserpens, Quadricoccus, Quinella, Rahnella, Ralstonia, Ramlibacter, Raoultella, Rarobacter, Rathayibacter, Reichenbachia, Renibacterium, Rhabdochromatium, Rheinheimera, Rhizobacter, Rhizobium, Rhizomonas, Rhodanobacter, Rhodobaca, Rhodobacter, Rhodobium, Rhodoblastus, Rhodocista, Rhodococcus, Rhodocyclus, Rhodoferax, Rhodoglobus, Rhodomicrobium, Rhodopila, Rhodoplanes, Rhodopseudomonas, Rhodospira, Rhodospirillum, Rhodothalassium, Rhodothermus, Rhodovibrio, Rhodovulum, Rickettsia, Rickettsiella, Riemerella, Rikenella, Rochalimaea, Roseateles, Roseburia, Roseibium, Roseiflexus, Roseinatronobacter, Roseivivax, Roseobacter, Roseococcus, Roseomonas, Roseospira, Roseospirillum, Roseovarius, Rothia, Rubrimonas, Rubritepida, Rubrivivax, Rubrobacter, Ruegeria, Rugamonas, Ruminobacter, Ruminococcus, Runella, Saccharobacter, Saccharococcus, Saccharomonospora, Saccharopolyspora, Saccharospirillum, Saccharothrix, Sagittula, Salana, Salegentibacter, Salibacillus, Salinibacter, Salinibacterium, Salinicoccus, Salinisphaera,

*Salinivibrio, Salmonella, Samsonia, Sandaracinobacter, Sanguibacter, Saprospira, Sarcina, Sarcobium, Scardovia, Schineria, Schlegelella, Schwartzia, Sebaldella, Sedimentibacter, Selenihalanaerobacter, Selenomonas, Seliberia, Serpens, Serpula, Serpulina, Serratia, Shewanella, Shigella, Shuttleworthia, Silicibacter, Simkania, Simonsiella, Sinorhizobium, Skermanella, Skermania, Slackia, Smithella, Sneathia, Sodalis, Soehngenia, Solirubrobacter, Solobacterium, Sphaerobacter, Sphaerotilus, Sphingobacterium, Sphingobium, Sphingomonas, Sphingopyxis, Spirilliplanes, Spirillospora, Spirillum, Spirochaeta, Spiroplasma, Spirosoma, Sporanaerobacter, Sporichthya, Sporobacter, Sporobacterium, Sporocytophaga, Sporohalobacter, Sporolactobacillus, Sporomusa, Sporosarcina, Sporotomaculum, Staleya, Staphylococcus, Stappia, Starkeya, Stella, Stenotrophomonas, Sterolibacterium, Stibiobacter, Stigmatella, Stomatococcus, Streptacidiphilus, Streptimonospora, Streptoalloteichus, Streptobacillus, Streptococcus, Streptomonospora, Streptomyces: S. abikoensis, S. erumpens, S. erythraeus, S. michiganensis, S. microflavus, S. zaomyceticus, Streptosporangium, Streptoverticillium, Subtercola, Succiniclasticum, Succinimonas, Succinispira, Succinivibrio, Sulfitobacter, Sulfobacillus, Sulfurihydrogenibium, Sulfurimonas, Sulfurospirillum, Sutterella, Suttonella, Symbiobacterium, Symbiotes, Synergistes, Syntrophobacter, Syntrophobotulus, Syntrophococcus, Syntrophomonas, Syntrophosphora, Syntrophothermus, Syntrophus, Tannerella, Tatlockia, Tatumella, Taylorella, Tectibacter, Teichococcus, Telluria, Tenacibaculum, Tepidibacter, Tepidimonas, Tepidiphilus, Terasakiella, Teredinibacter, Terrabacter, Terracoccus, Tessaracoccus, Tetragenococcus, Tetrasphaera, Thalassomonas, Thalassospira, Thauera, Thermacetogenium, Thermaerobacter, Thermanaeromonas, Thermanaerovibrio, Thermicanus, Thermithiobacillus, Thermoactinomyces, Thermoanderobacter, Thermoanaerobacterium, Thermoanaerobium, Thermobacillus, Thermobacteroides, Thermobifida, Thermobispora, Thermobrachium, Thermochromatium, Thermocrinis, Thermocrispum, Thermodesulfobacterium, Thermodesulforhabdus, Thermodesulfovibrio, Thermohalobacter, Thermohydrogenium, Thermoleophilum, Thermomicrobium, Thermomonas, Thermomonospora, Thermonema, Thermosipho, Thermosyntropha, Thermoterrabacterium, Thermothrix, Thermotoga, Thermovenabulum, Thermovibrio, Thermus, Thialkalicoccus, Thialkalimicrobium, Thialkalivibrio, Thioalkalicoccus, Thioalkalimicrobium, Thioalkalispira, Thioalkalivibrio, Thiobaca, Thiobacillus, Thiobacterium, Thiocapsa, Thiococcus, Thiocystis, Thiodictyon, Thioflavicoccus, Thiohalocapsa, Thiolamprovum, Thiomargarita, Thiomicrospira, Thiomonas, Thiopedia, Thioploca, Thiorhodococcus, Thiorhodospira, Thiorhodovibrio, Thiosphaera, Thiospira, Thiospirillum, Thiothrix, Thiovulum, Tindallia, Tissierella, Tistrella, Tolumonas, Toxothrix, Trabulsiella, Treponema, Trichlorobacter, Trichococcus, Tropheryma, Tsukamurella, Turicella, Turicibacter, Tychonema, Ureaplasma, Ureibacillus, Vagococcus, Vampirovibrio, Varibaculum, Variovorax, Veillonella, Verrucomicrobium, Verrucosispora, Vibrio, Victivallis, Virgibacillus, Virgisporangium, Virgosporangium, Vitellibacter, Vitreoscilla, Vogesella, Volcaniella, Vulcanithermus, Waddlia, Weeksella, Weissella, Wigglesworthia, Williamsia, Wolbachia, Wolinella, Xanthobacter, Xanthomonas, Xenophilus, Xenorhabdus, Xylanimonas, Xylella, Xylophilus, Yersinia, Yokenella, Zavarzinia, Zobellia, Zoogloea, Zooshikella, Zymobacter, Zymomonas,* and *Zymophilus.*

Production of a Phage Display Library

General methods for producing a phage display library are known to those of skill in the art and/or are described in e.g., Larman et al. (2011) Nature Biotechnology 29(6):535-541, which is incorporated herein by reference in its entirety.

Contemplated herein are phage display libraries that comprise a plurality of peptides derived from a plurality of pathogens, such as bacteria, fungi, or viruses. In one embodiment, it is contemplated herein that the plurality of peptides will represent a substantially complete set of peptides from a group of viruses, bacteria, or fungi (e.g., all pathogenic viruses, bacteria or fungi). In one embodiment, the phage display library comprises a substantially complete set of peptides from viruses known to infect humans (or a subgroup thereof). Similarly, phage display libraries comprising a substantially complete set of peptides from pathogenic bacteria (or a subgroup thereof) or pathogenic fungi (or a subgroup thereof) are also contemplated herein. As used herein, the term "subgroup" refers to a related grouping of viruses, bacteria or fungi that would benefit from simultaneous testing. For example, one of skill in the art can generate a phage display library comprising a substantially complete set of peptides from a genus of pathogens (e.g., a subgroup of virus, such as the Herpes genus). Such a library would permit one of skill in the art to distinguish between highly related pathogens in an antibody sample.

In some embodiments, the phage display library comprises less than 10,000 peptide sequences. In other embodiments, the phage display library comprises less than 9000, less than 8000, less than 7000, less than 6000, less than 5000, less than 4000, less than 3000, less than 2000, less than 1000, less than 750, less than 500, less than 250, less than 100, less than 50 or less than 25 peptide sequences. In other embodiments, the phage display library comprises at least 100, at least 200, at least 500, at least 1000, at least 5000, at least 10,000 peptide sequences or more. It will be appreciated by one of ordinary skill in the art that as the length of the individual peptide sequences increase, the total number of peptide sequences in the library can decrease without loss of any pathogen sequences (and vice versa).

In some embodiments, the phage display library comprises peptides derived from at least 10 protein sequences (e.g., viral protein sequences), at least 20 protein sequences, at least 30 protein sequences, at least 40 protein sequences, at least 50 protein sequences, at least 60 protein sequences, at least 70 protein sequences, at least 80 protein sequences, at least 90 protein sequences, at least 100 protein sequences, at least 200 protein sequences, at least 300 protein sequences, at least 400 protein sequences, at least 500 protein sequences, at least 600 protein sequences, at least 700 protein sequences, at least 800 protein sequences, at least 900 protein sequences, at least 1000 protein sequences, at least 2000 protein sequences, at least 3000 protein sequences, at least 4000 protein sequences, at least 5000 protein sequences, at least 6000 protein sequences, at least 6500 protein sequences, at least 7000 protein sequences, at least 7500 protein sequences, at least 8000 protein sequences, at least 8500 protein sequences, at least 9000 protein sequences, at least 10,000 protein sequences or more.

In some embodiments, the phage display library comprises a plurality of proteins sequence that have less than 90% shared identity; in other embodiments the plurality of protein sequences have less than 85% shared identity, less than 80% shared identity, less than 75% shared identity, less than 70% shared identity, less than 65% shared identity, less than 60% shared identity, less than 55% shared identity, less than 50% shared identity or even less.

In some embodiments, the phage display library comprises protein sequences from at least 3 unique pathogens or at least 5 unique pathogens (e.g., 5 unique viruses, 5 unique bacteria, or 5 unique fungi); in other embodiments the library comprises protein sequences from at least 10, at least 20, at least 50, at least 75, at least 100, at least 200, at least 300, at least 400, at least 500, at least 600, at least 700, at least 800, at least 900, at least 1000 unique pathogens up to and including protein sequences from all viruses, bacteria, or fungi known to cause disease in a human or other mammal.

In some embodiments, the protein sequences of the phage display library are at least 10 amino acids long; in other embodiments the protein sequences are at least 20, at least 30, at least 40, at least 50, at least 60, at least 70, at least 80, at least 90, at least 100, at least 150, at least 200, at least 250, at least 300, at least 350, at least 400, at least 450 amino acids or more in length.

In some embodiments, each peptide of the phage library will overlap at least one other peptide by at least 5 amino acids. In other embodiments, each peptide of the phage library will overlap at least one other peptide by at least 10, at least 15, at least 20, at least 21, at least 22, at least 23, at least 24, at least 25, at least 26, at least 27, at least 28, at least 29, at least 30, at least 32, at least 35, at least 40 amino acids or more.

In some embodiments, the display library comprises at least 2 peptides from Table 4. In other embodiments, the display library comprises at least 3, at least 4, at least 5, at least 6, at least 7, at least 8, at least 9, at least 10, at least 15, at least 20, at least 30, at least 40, at least 50, at least 60, at least 70, at least 80, at least 90, at least 100, at least 200, at least 300, at least 400, at least 500, at least 600, at least 700, at least 800, at least 900, at least 1000, at least 2000, at least 3000, at least 4000, at least 5000 peptides or more as selected in any desired combination from Table 4. In some embodiments, the display library comprises all of the peptides in Table 4.

In certain embodiments, the display library can comprise peptides from at least 1 family (e.g., human herpesvirus) or sub-family (e.g., human herpesvirus 5) of related viruses. In other embodiments, the display library can comprise peptides from at least 2 families, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 25, at least 30, at least 35, at least 40, at least 45, or at least 50 peptides from at least 1 family (e.g., human herpesvirus) or sub-family (e.g., human herpesvirus 5) of viruses from Table 4, in any desired combination. In one embodiment, the display library comprises peptides from each of the viral families or subfamilies in Table 4.

Reaction Samples

As used herein, the term "reaction sample" refers to a sample that, at a minimum, comprises a phage display library, for example, the phage display library described herein. The reaction sample can also comprise additional buffers, salts, osmotic agents, etc. to facilitate the formation of complexes between the peptides in the phage display library when the reaction sample is contacted with a biological sample comprising an antibody. A "biological sample" as that term is used herein refers to a fluid or tissue sample derived from a subject that comprises or is suspected of comprising at least one antibody.

A biological sample can be obtained from any organ or tissue in the individual to be tested, provided that the biological sample comprises, or is suspected of comprising, an antibody. Typically the biological sample will comprise a blood sample, however other biological samples are contemplated herein, for example, cerebrospinal fluid.

In some embodiments, a biological sample is treated to remove cells or other biological particulates. Methods for removing cells from a blood or other biological sample are well known in the art and can include e.g., centrifugation, ultrafiltration; immune selection, or sedimentation etc. Antibodies can be detected from a biological sample or a sample that has been treated as described above or as known to those of skill in the art. Some non-limiting examples of biological samples include a blood sample, a urine sample, a semen sample, a lymphatic fluid sample, a cerebrospinal fluid sample, a plasma sample, a serum sample, a pus sample, an amniotic fluid sample, a bodily fluid sample, a stool sample, a biopsy sample, a needle aspiration biopsy sample, a swab sample, a mouthwash sample, a cancer sample, a tumor sample, a tissue sample, a cell sample, a synovial fluid sample, or a combination of such samples. For the methods described herein, it is preferred that a biological sample is from whole blood, plasma, cerebral spinal fluid, serum, and/or urine. In one embodiment, the biological sample is cerebrospinal fluid.

In some embodiments, samples can be obtained from an individual with a disease or pathological condition. In one embodiment, the disease or pathological condition is one that is suspected of having a common viral, bacterial or fungal origin. Some exemplary disease or pathological conditions include, but not limited to: a blood disorder, blood lipid disease, autoimmune disease, bone or joint disorder, a cardiovascular disorder, respiratory disease, endocrine disorder, immune disorder, infectious disease, muscle wasting and whole body wasting disorder, neurological disorders including neurodegenerative and/or neuropsychiatric diseases, skin disorder, kidney disease, scleroderma, stroke, hereditary hemorrhage telangiectasia, diabetes (e.g., Type I or Type II diabetes), disorders associated with diabetes (e.g., PVD), hypertension, Gaucher's disease, Kawasaki disease, Bell's palsy, Meniere's disease, juvenile idiopathic arthritis, chronic fatigue syndrome, Gulf War illness, Myasthenia Gravis, IgG4 disease, cystic fibrosis, sickle cell anemia, liver disease, pancreatic disease, eye, ear, nose and/or throat disease, diseases affecting the reproductive organs, gastrointestinal diseases (including diseases of the colon, diseases of the spleen, appendix, gall bladder, and others) and the like. For further discussion of human diseases, see Mendelian Inheritance in Man: A Catalog of Human Genes and Genetic Disorders by Victor A. McKusick (12th Edition (3 volume set) June 1998, Johns Hopkins University Press, ISBN: 0801857422), the entirety of which is incorporated herein. Preferably, samples from a normal demographically matched individual and/or from a non-disease sample from a patient having the disease are used in the analysis to provide controls. The samples can comprise a plurality of cells from individuals sharing a trait. For example, the trait shared can be gender, age, pathology, predisposition to a pathology, exposure to an infectious disease (e.g., HIV), kinship, death from the same disease, treatment with the same drug, exposure to chemotherapy, exposure to radiotherapy, exposure to hormone therapy, exposure to surgery, exposure to the same environmental condition (e.g., such as carcinogens, pollutants, asbestos, TCE, perchlorate, benzene, chloroform, nicotine and the like), the same genetic alteration or group of alterations, expression of the same gene or sets of genes (e.g., samples can be from individuals sharing a common haplotype, such as a particular set of HLA alleles), and the like.

Removal of Unbound Phage

In some embodiments, the methods and assays described herein comprise a step of contacting modified bacteriophage or the phage display library as described herein with a biological sample that comprises, or is suspected of comprising, at least one antibody. Any antiviral antibodies present in the biological sample will bind to bacteriophage(s) that display the cognate antigen.

In certain embodiments, it is desirable to separate the bacteriophage(s) bound to an antibody in the biological sample from any free bacteriophage(s) that are not bound to an antibody in the sample. In one embodiment, antibodies from the reaction sample are immobilized on a solid support to permit one to separate out the unbound phage. Antibody immobilization can be achieved using methods routine to those of ordinary skill in the art. Essentially any method that permits one to specifically immobilize IgM, IgA, or IgG subclasses (e.g., IgG4) can be used to immobilize antibodies from the sample, including antibodies that are complexed to one or more bacteriophage. In some embodiments, Protein A, Protein G or a combination thereof is/are used to immobilize the antibody to permit removal of unbound phage. Such methods are known to those of ordinary skill in the art and as such are not described in detail herein.

In some embodiments, the peptide or protein used to immobilize antibodies from the reaction mixture can be attached to a solid support, such as, for example, magnetic beads (e.g., micron-sized magnetic beads), Sepharose beads, agarose beads, a nitrocellulose membrane, a nylon membrane, a column chromatography matrix, a high performance liquid chromatography (HPLC) matrix or a fast performance liquid chromatography (FPLC) matrix for purification. For example, the reaction mixture comprising bacteriophage and antibodies can be contacted with magnetic beads coated with Protein A and/or Protein G. The Protein A and G will bind to antibodies in the mixture and immobilize them on the beads. This process also immobilizes any phage particles bound by the antibodies. In one embodiment, a magnet can be used to separate the immobilized phage from unbound phage.

As used herein, the term "Magnetic bead" means any solid support that is attracted by a magnetic field; such solid supports include, without limitation, DYNABEADS™, BIOMAG™ Streptavidin, MPG7 Streptavidin, Streptavidin MAGNESPHERE™, Streptavidin Magnetic Particles, AFFINITIP™, any of the MAGA™ line of magnetizable particles, BIOMAG™ Superparamagnetic Particles, or any other magnetic bead to which a molecule (e.g., an oligonucleotide primer) may be attached or immobilized.

Peptide Detection

Following a step to remove any unbound phage, the peptides in the bound phage/antibody complexes can be identified using e.g., PCR. Although not necessary, the bound phage/antibody complexes can first be released from the solid support using appropriate conditions e.g., temperature, pH, etc. In some embodiments, the sample is subjected to conditions that will permit lysis of the phage (e.g., heat denaturation). In one embodiment, the nucleic acids from the lysed phage is subjected to an amplification reaction, such as a PCR reaction. In one embodiment, the nucleic acids encoding a phage-displayed peptide comprise a common adapter sequence for PCR amplification. In such embodiments, a PCR primer is designed to bind to the common adapter sequence for amplification of the DNA corresponding to a phage-displayed peptide.

In some embodiments, a detectable label is used in the amplification reaction to permit detection of different amplification products. As used herein, "label" or "detectable label" refers to any atom or molecule which can be used to provide a detectable (preferably quantifiable) signal, and which can be operatively linked to a polynucleotide, such as a PCR primer. Labels may provide signals detectable by fluorescence, radioactivity, colorimetry, gravimetry, X-ray diffraction or absorption, magnetism, enzymatic activity, mass spectrometry, binding affinity, hybridization radiofrequency, nanocrystals and the like. A primer of the present invention may be labeled so that the amplification reaction product may be "detected" by "detecting" the detectable label. "Qualitative or quantitative" detection refers to visual or automated assessments based upon the magnitude (strength) or number of signals generated by the label. A labeled polynucleotide (e.g., an oligonucleotide primer) according to the methods of the invention can be labeled at the 5' end, the 3' end, or both ends, or internally. The label can be "direct", e.g., a dye, or "indirect", e.g., biotin, digoxin, alkaline phosphatase (AP), horse radish peroxidase (HRP). For detection of "indirect labels" it is necessary to add additional components such as labeled antibodies, or enzyme substrates to visualize the captured, released, labeled polynucleotide fragment. In a preferred embodiment, an oligonucleotide primer is labeled with a fluorescent label. Suitable fluorescent labels include fluorochromes such as rhodamine and derivatives (such as Texas Red), fluorescein and derivatives (such as 5-bromomethyl fluorescein), Lucifer Yellow, IAEDANS, 7-Me.sub.2N-coumarin-4-acetate, 7-OH-4-CH$_3$-coumarin-3-acetate, 7-NH.sub.2-4-CH$_3$-coumarin-3-acetate (AMCA), monobromobimane, pyrene trisulfonates, such as Cascade Blue, and monobromorimethyl-ammoniobimane (see for example, DeLuca, Immunofluorescence Analysis, in Antibody As a Tool, Marchalonis, et al., eds., John Wiley & Sons, Ltd., (1982), which is incorporated herein by reference).

The methods described herein can benefit from the use of labels including, e.g., fluorescent labels. In one aspect, the fluorescent label can be a label or dye that intercalates into or otherwise associates with amplified (usually double-stranded) nucleic acid molecules to give a signal. One stain useful in such embodiments is SYBR Green (e.g., SYBR Green I or II, commercially available from Molecular Probes Inc., Eugene, Oreg.). Others known to those of skill in the art can also be employed in the methods described herein. An advantage of this approach is reduced cost relative to the use of, for example, labeled nucleotides.

As used herein, the term "amplified product" refers to polynucleotides which are copies of a portion of a particular polynucleotide sequence and/or its complementary sequence, which correspond in nucleotide sequence to the template polynucleotide sequence and its complementary sequence. An "amplified product," can be DNA or RNA, and it may be double-stranded or single-stranded.

Exemplary Methods for Peptide Detection

In an exemplary embodiment, the phage are lysed by heat denaturation and PCR is used to amplify the DNA region corresponding to the displayed peptide sequence. One of the PCR primers contains a common adaptor sequence which can be amplified in a second PCR reaction by another set of primers to prepare the DNA for ILLUMINA™ high throughput sequence. Unique barcoded oligonucleotides in the second PCR reaction are used to amplify different samples and pool them together in one sequencing run to e.g., reduce cost and/or permit simultaneous detection of multiple phage-displayed peptides.

High-Throughput Systems

In certain embodiments, the detection of a phage-displayed peptide comprises high throughput detection of a plurality of peptides simultaneously, or near simultaneously.

In some embodiments, the high-throughput systems use methods similar to DNA sequencing techniques.

A number of DNA sequencing techniques are known in the art, including fluorescence-based sequencing methodologies (See, e.g., Birren et al., Genome Analysis: Analyzing DNA, 1, Cold Spring Harbor, N.Y.). In some embodiments, automated sequencing techniques understood in the art are utilized. In some embodiments, the high-throughput systems described herein use methods that provide parallel sequencing of partitioned amplicons (e.g., WO2006084132). In some embodiments, DNA sequencing is achieved by parallel oligonucleotide extension (See, e.g., U.S. Pat. Nos. 5,750,341, and 6,306,597). Additional examples of sequencing techniques include the Church polony technology (Mitra et al., 2003, Analytical Biochemistry 320, 55-65; Shendure et al., 2005 Science 309, 1728-1732; U.S. Pat. Nos. 6,432,360, 6,485,944, 6,511,803), the 454 picotiter pyrosequencing technology (Margulies et al., 2005 Nature 437, 376-380; US 20050130173), the Solexa single base addition technology (Bennett et al., 2005, Pharmacogenomics, 6, 373-382; U.S. Pat. Nos. 6,787,308; 6,833,246), the Lynx massively parallel signature sequencing technology (Brenner et al. (2000). Nat. Biotechnol. 18:630-634; U.S. Pat. Nos. 5,695,934; 5,714, 330), and the Adessi PCR colony technology (Adessi et al. (2000). Nucleic Acid Res. 28, E87; WO 00018957).

Next-generation sequencing (NGS) methods share the common feature of massively parallel, high-throughput strategies, with the goal of lower costs in comparison to older sequencing methods (see, e.g., Voelkerding et al., Clinical Chem., 55: 641-658, 2009; MacLean et al., Nature Rev. Microbiol., 7:287-296). NGS methods can be broadly divided into those that typically use template amplification and those that do not. Amplification-requiring methods include pyrosequencing commercialized by Roche as the 454 technology platforms (e.g., GS 20 and GS FLX), the Solexa platform commercialized by ILLUMINA™, and the Supported Oligonucleotide Ligation and Detection™ (SOLiD) platform commercialized by APPLIED BIOSYSTEMS™. Non-amplification approaches, also known as single-molecule sequencing, are exemplified by the HELISCOPE™ platform commercialized by HELICOS BIOSYSTEMS™, and emerging platforms commercialized by VISIGEN™, OXFORD NANOPORE TECHNOLOGIES LTD., and PACIFIC BIOSCIENCES™, respectively.

In pyrosequencing (Voelkerding et al, Clinical Chem., 55: 641-658, 2009; MacLean et al., Nature Rev. Microbial., 7:287-296; U.S. Pat. Nos. 6,210,891; 6,258,568), template DNA is fragmented, end-repaired, ligated to adaptors, and clonally amplified in-situ by capturing single template molecules with beads bearing oligonucleotides complementary to the adaptors. Each bead bearing a single template type is compartmentalized into a water-in-oil microvesicle, and the template is clonally amplified using a technique referred to as emulsion PCR. The emulsion is disrupted after amplification and beads are deposited into individual wells of a picotitre plate functioning as a flow cell during the sequencing reactions. Ordered, iterative introduction of each of the four dNTP reagents occurs in the flow cell in the presence of sequencing enzymes and luminescent reporter such as luciferase. In the event that an appropriate dNTP is added to the 3' end of the sequencing primer, the resulting production of ATP causes a burst of luminescence within the well, which is recorded using a CCD camera. It is possible to achieve read lengths greater than or equal to 400 bases, and $10^6$ sequence reads can be achieved, resulting in up to 500 million base pairs (Mb) of sequence.

In the SOLEXA/ILLUMINA platform (Voelkerding et al., Clinical Chem., 55. 641-658, 2009; MacLean et al., Nature Rev. Microbial., 7:287-296; U.S. Pat. Nos. 6,833,246; 7,115, 400; 6,969,488), sequencing data are produced in the form of shorter-length reads. In this method, single-stranded fragmented DNA is end-repaired to generate 5'-phosphorylated blunt ends, followed by Klenow-mediated addition of a single A base to the 3' end of the fragments. A-addition facilitates addition of T-overhang adaptor oligonucleotides, which are subsequently used to capture the template-adaptor molecules on the surface of a flow cell that is studded with oligonucleotide anchors. The anchor is used as a PCR primer, but because of the length of the template and its proximity to other nearby anchor oligonucleotides, extension by PCR results in the "arching over" of the molecule to hybridize with an adjacent anchor oligonucleotide to form a bridge structure on the surface of the flow cell. These loops of DNA are denatured and cleaved. Forward strands are then sequenced with reversible dye terminators. The sequence of incorporated nucleotides is determined by detection of post-incorporation fluorescence, with each fluor and block removed prior to the next cycle of dNTP addition. Sequence read length ranges from 36 nucleotides to over 50 nucleotides, with overall output exceeding 1 billion nucleotide pairs per analytical run.

Sequencing nucleic acid molecules using SOLID™ technology (Voelkerding et al., Clinical Chem., 55: 641-658, 2009; MacLean et al., Nature Rev. Microbial., 7:287-296; U.S. Pat. Nos. 5,912,148; 6,130,073) also involves fragmentation of the template, ligation to oligonucleotide adaptors, attachment to beads, and clonal amplification by emulsion PCR. Following this, beads bearing template are immobilized on a derivatized surface of a glass flow-cell, and a primer complementary to the adaptor oligonucleotide is annealed. However, rather than utilizing this primer for 3' extension, it is instead used to provide a 5' phosphate group for ligation to interrogation probes containing two probe-specific bases followed by 6 degenerate bases and one of four fluorescent labels. In the SOLID™ system, interrogation probes have 16 possible combinations of the two bases at the 3' end of each probe, and one of four fluors at the 5' end. Fluor color, and thus identity of each probe, corresponds to specified color-space coding schemes. Multiple rounds (usually 7) of probe annealing, ligation, and fluor detection are followed by denaturation, and then a second round of sequencing using a primer that is offset by one base relative to the initial primer. In this manner, the template sequence can be computationally re-constructed, and template bases are interrogated twice, resulting in increased accuracy. Sequence read length averages 35 nucleotides, and overall output exceeds 4 billion bases per sequencing run.

In certain embodiments, nanopore sequencing is employed (see, e.g., Astier et al., J. Am. Chem. Soc. 2006 Feb. 8; 128(5)1705-10). The theory behind nanopore sequencing has to do with what occurs when a nanopore is immersed in a conducting fluid and a potential (voltage) is applied across it. Under these conditions a slight electric current due to conduction of ions through the nanopore can be observed, and the amount of current is exceedingly sensitive to the size of the nanopore. As each base of a nucleic acid passes through the nanopore, this causes a change in the magnitude of the current through the nanopore that is distinct for each of the four bases, thereby allowing the sequence of the DNA molecule to be determined.

In certain embodiments, HELISCOPE™ by HELICOS BIOSCIENCES™ is employed (Voelkerding et al., Clinical Chem., 55. 641-658, 2009; MacLean et al., Nature Rev.

*Microbial,* 7:287-296; U.S. Pat. Nos. 7,169,560; 7,282,337; 7,482,120; 7,501,245; 6,818,395; 6,911,345; 7,501,245). Template DNA is fragmented and polyadenylated at the 3' end, with the final adenosine bearing a fluorescent label. Denatured polyadenylated template fragments are ligated to poly(dT) oligonucleotides on the surface of a flow cell. Initial physical locations of captured template molecules are recorded by a CCD camera, and then label is cleaved and washed away. Sequencing is achieved by addition of poly-merase and serial addition of fluorescently-labeled dNTP reagents. Incorporation events result in fluor signal corre-sponding to the dNTP, and signal is captured by a CCD camera before each round of dNTP addition. Sequence read length ranges from 25-50 nucleotides, with overall output exceeding 1 billion nucleotide pairs per analytical run.

The Ion Torrent technology is a method of DNA sequenc-ing based on the detection of hydrogen ions that are released during the polymerization of DNA (see, e.g., *Science* 327 (5970): 1190 (2010); U.S. Pat. Appl. Pub. Nos. 20090026082, 20090127589, 20100301398, 20100197507, 20100188073, and 20100137143). A microwell contains a template DNA strand to be sequenced. Beneath the layer of microwells is a hypersensitive ISFET ion sensor. All layers are contained within a CMOS semiconductor chip, similar to that used in the electronics industry. When a dNTP is incorporated into the growing complementary strand a hydrogen ion is released, which triggers a hypersensitive ion sensor. If homopolymer repeats are present in the template sequence, multiple dNTP molecules will be incorporated in a single cycle. This leads to a corresponding number of released hydrogens and a proportionally higher electronic signal. This technology differs from other sequencing tech-nologies in that no modified nucleotides or optics are used. The per base accuracy of the Ion Torrent sequencer is .about.99.6% for 50 base reads, with ~100 Mb generated per run. The read-length is 100 base pairs. The accuracy for homopolymer repeats of 5 repeats in length is ~98%.

Another exemplary nucleic acid sequencing approach that CAN be adapted for use with the methods described herein was developed by STRATOS GENOMICS, Inc. and involves the use of XPANDOMERS™. This sequencing process typically includes providing a daughter strand pro-duced by a template-directed synthesis. The daughter strand generally includes a plurality of subunits coupled in a sequence corresponding to a contiguous nucleotide sequence of all or a portion of a target nucleic acid in which the individual subunits comprise a tether, at least one probe or nucleobase residue, and at least one selectively cleavable bond. The selectively cleavable bond(s) is/are cleaved to yield an XPANDOMER™ of a length longer than the plurality of the subunits of the daughter strand. The XPAN-DOMER™ typically includes the tethers and reporter ele-ments for parsing genetic information in a sequence corre-sponding to the contiguous nucleotide sequence of all or a portion of the target nucleic acid. Reporter elements, of the XPANDOMER™ are then detected. Additional details relat-ing to XPANDOMER™-based approaches are described in, for example, U.S. Pat. Pub No. 20090035777, entitled "HIGH THROUGHPUT NUCLEIC ACID SEQUENCING BY EXPANSION," filed Jun. 19, 2008, which is incorpo-rated herein in its entirety.

Other emerging single molecule sequencing methods include real-time sequencing by synthesis using a VISI-GEN™ platform (Voelkerding et al., *Clinical Chem.,* 55: 641-58, 2009; U.S. Pat. No. 7,329,492; U.S. patent appli-cation Ser. No. 11/671,956; U.S. patent application Ser. No. 11/781,166) in which immobilized, primed DNA template is subjected to strand extension using a fluorescently-modified polymerase and florescent acceptor molecules, resulting in detectible fluorescence resonance energy transfer (FRET) upon nucleotide addition.

Another real-time single molecule sequencing system developed by PACIFIC BIOSCIENCES™ (Voelkerding et al., *Clinical Chem.,* 55. 641-658, 2009; MacLean et al., *Nature Rev. Microbiol.,* 7:287-296; U.S. Pat. Nos. 7,170, 050; 7,302,146; 7,313,308; 7,476,503) utilizes reaction wells 50-100 nm in diameter and encompassing a reaction volume of approximately 20 zeptoliters ($10^{-21}$ L). Sequenc-ing reactions are performed using immobilized template, modified phi29 DNA polymerase, and high local concentra-tions of fluorescently labeled dNTPs. High local concentra-tions and continuous reaction conditions allow incorporation events to be captured in real time by fluor signal detection using laser excitation, an optical waveguide, and a CCD camera.

In certain embodiments, the single molecule real time (SMRT) DNA sequencing methods using zero-mode wave-guides (ZMWs) developed by Pacific Biosciences, or similar methods, are employed. With this technology, DNA sequencing is performed on SMRT chips, each containing thousands of zero-mode waveguides (ZMWs). A ZMW is a hole, tens of nanometers in diameter, fabricated in a 100 nm metal film deposited on a silicon dioxide substrate. Each ZMW becomes a nanophotonic visualization chamber pro-viding a detection volume of just 20 zeptoliters ($10^{-21}$ L). At this volume, the activity of a single molecule can be detected amongst a background of thousands of labeled nucleotides. The ZMW provides a window for watching DNA poly-merase as it performs sequencing by synthesis. Within each chamber, a single DNA polymerase molecule is attached to the bottom surface such that it permanently resides within the detection volume. Phospholinked nucleotides, each type labeled with a different colored fluorophore, are then intro-duced into the reaction solution at high concentrations which promote enzyme speed, accuracy, and processivity. Due to the small size of the ZMW, even at these high, biologically relevant concentrations, the detection volume is occupied by nucleotides only a small fraction of the time. In addition, visits to the detection volume are fast, lasting only a few microseconds, due to the very small distance that diffusion has to carry the nucleotides. The result is a very low background.

Processes and systems for such real time sequencing that can be adapted for use with the methods described herein include, for example, U.S. Pat. Nos. 7,405,281, 7,315,019, 7,313,308, 7,302,146, 7,170,050, U.S. Pat. Pub. Nos. 20080212960, 20080206764,20080199932,20080176769, 20080176316,20080176241,20080165346,20080160531, 20080157005,20080153100,20080153095,20080152281, 20080152280,20080145278,20080128627, 20080108082, 20080095488,20080080059,20080050747,20080032301, 20080030628,20080009007, 20070238679,20070231804, 20070206187,20070196846,20070188750,20070161017, 20070141598, 20070134128, 20070128133, 20070077564, 20070072196, 20070036511, and Korlach et al. (2008) *PNAS* 105(4): 1176-81, all of which are herein incorporated by reference in their entireties.

Subsequently, in some embodiments, the data produced comprises sequence data from multiple barcoded DNAs. Using the known association between the barcode and the source of the DNA, the data can be deconvoluted to assign sequences to the source subjects, samples, organisms, etc. The sequences are mapped, in some embodiments, to a reference DNA sequence (e.g., a chromosome) and genotypes are assigned to the source subjects, samples, organisms, etc., e.g., by modeling, e.g., by a Hidden Markov Model.

Some embodiments provide a processor, data storage, data transfer, and software comprising instructions to assign genotypes. Some embodiments of the technology provided herein further comprise functionalities for collecting, storing, and/or analyzing data. For example, some embodiments comprise the use of a processor, a memory, and/or a database for, e.g., storing and executing instructions, analyzing data, performing calculations using the data, transforming the data, and storing the data. In some embodiments, the processor is configured to calculate a function of data derived from the sequences and/or genotypes determined. In some embodiments, the processor performs instructions in software configured for medical or clinical results reporting and in some embodiments the processor performs instructions in software to support non-clinical results reporting.

In some embodiments, the detection of a phage-displayed peptide comprises PCR with barcoded oligonucleotides. As used herein, the term "barcode" refers to a unique oligonucleotide sequence that allows a corresponding nucleic acid base and/or nucleic acid sequence to be identified. In certain aspects, the nucleic acid base and/or nucleic acid sequence is located at a specific position on a larger polynucleotide sequence (e.g., a polynucleotide covalently attached to a bead). In certain embodiments, barcodes can each have a length within a range of from 4 to 36 nucleotides, or from 6 to 30 nucleotides, or from 8 to 20 nucleotides. In certain aspects, the melting temperatures of barcodes within a set are within 10° C. of one another, within 5° C. of one another, or within 2° C. of one another. In other aspects, barcodes are members of a minimally cross-hybridizing set. That is, the nucleotide sequence of each member of such a set is sufficiently different from that of every other member of the set that no member can form a stable duplex with the complement of any other member under stringent hybridization conditions. In one aspect, the nucleotide sequence of each member of a minimally cross-hybridizing set differs from those of every other member by at least two nucleotides. Barcode technologies are known in the art and are described in e.g., Winzeler et al. (1999) *Science* 285:901; Brenner (2000) *Genome Biol.* 1:1 Kumar et al. (2001) *Nature Rev.* 2:302; Giaever et al. (2004) *Proc. Natl. Acad. Sci. USA* 101:793; Eason et al. (2004) *Proc. Natl. Acad. Sci. USA* 101:11046; and Brenner (2004) *Genome Biol.* 5:240.

Contemplated Applications of the Phage Display Library

The described technology allows for detection of such past (e.g., resolved or unresolved infections) or ongoing infection by detecting host antibody response to a pathogen such as a virus, bacteria, or fungi. Using the described systems and methods, wherein a comprehensive peptide phage library can capture virtually all host generated antibodies, the simultaneous detection of the complete antiviral antibody responses as an indicator of virus infection against virtually all known viruses capable of infecting humans. Uniquely, because antibody response persist for long periods of time, this approach further allows for detection of prior exposure, where an infection has been contained. These responses can therefore be used as an indicator not only a person's past ongoing infections, but resolved ones as well.

In addition to the aforementioned diagnostic uses, this technology further provides a mechanism to identify viral correlates or causes of disease. Many diseases suspected have a viral cause, but without positive identification of a responsible pathogen. Examples include Kawasaki Disease, Bell's Palsy, Meniere's Disease, Type I Diabetes and Juvenile Idiopathic Arthritis. In each of these diseases and/or dysfunctional conditions, viral correlates of onset or severity have been suggested, but a pathogenic origin cannot be identified due to the lack of system-wide screening techniques for viral exposure, and researchers must rely on piecemeal detection schemes in order to narrow down possible disease-causing agents. In contrast, the described systems and methods provide not only a systematic approach to compare antiviral responses in patient and control sera to identify viral correlates of disease, but across virtually all viruses known to infect humans, allowing for a much improved route for identifying responsible pathogens.

In addition, the detection of antiviral antibody responses in subjects further allows identification of critical antigen peptide epitopes. The high-throughput nature of the described technology also allows rapid and wide-scale detection of such signatures across various subjects, thereby providing means for mapping of antiviral antibody epitopes across populations, which is not possible with existing technology. In addition to aiding antibody design for therapy, this information further allows identification of potential cross-reactivity with human antigens, a key source of autoimmune disease generation.

Importantly, a critical aspect of establishing programmable microarrays to include viral peptides is generation of an appropriate oligonucleotide sequence set for library generation. Importantly, wide-scale, parallel detection of viral antigens is particularly challenging, given their highly adaptive evolutionary nature and comparatively small antigenic signature compared to a library of human peptides, as one example. As unique library members may provide only short differences in antigenic sequence, the Inventors have improved algorithms for designing oligonucleotide sequences from parental protein sequences using randomized codons to minimize redundancy, and in order to increase the ability to align short reads to unique members of the library.

Importantly, the programmable microarray approach described herein, further including the antibody-focused adaptions, algorithms to design oligonucleotide sequences with reduced redundancy, and/or short read alignments, all lend themselves for wide extension of the programmable microarray technology to detection of other pathogens (e.g., bacteria or fungi), as well as adaption into other display systems (e.g., ribosome display, arrayed peptide, or yeast display). In this regard, the combination of advantages described herein provide a wide-ranging, systematic approach for using host antibody response as a means to identify past and present pathogen exposure.

The proteomic technology described herein applies a phage library that can uniformly express peptide libraries, such as synthetic representations of a complete set of viral peptides known to infect humans. Using this approach, the Inventors demonstrate viral peptides enriched by donor serum are highly reproducible and sera from different donors, on the other hand, recognize distinct profiles of peptides presumably commensurate with their previous unique histories of viral exposure. Moreover, using this approach, the Inventors identified a known epitope in the EBV BRRF2 protein that is cross-reactive with autoimmune antigens in patients with multiple sclerosis. The described systems and methods can therefore be applied to determine common antiviral antibody responses in people immunized against viruses in order to improve vaccine design.

All references cited herein are incorporated by reference in their entirety as though fully set forth. Unless defined otherwise, technical and scientific terms used herein have the same meaning as commonly understood by one of ordinary skill in the art to which this invention belongs. Singleton et al., *Dictionary of Microbiology and Molecular Biology* 4<sup>th</sup> ed., J. Wiley & Sons (New York, NY 2012); March, *Advanced Organic Chemistry Reactions, Mechanisms and Structure* 5<sup>th</sup> ed., J. Wiley & Sons (New York, NY 2001); and Sambrook and Russel, *Molecular Cloning: A Laboratory Manual* 4th ed., Cold Spring Harbor Laboratory Press (Cold Spring Harbor, NY 2012); provide one skilled in the art with a general guide to many of the terms used in the present application.

One skilled in the art will recognize many methods and materials similar or equivalent to those described herein, which could be used in the practice of the present invention. Indeed, the present invention is in no way limited to the methods and materials described. For purposes of the present invention, the following terms are defined below.

As used in the description herein and throughout the claims that follow, the meaning of "a," "an," and "the" includes plural reference unless the context clearly dictates otherwise. Also, as used in the description herein, the meaning of "in" includes "in" and "on" unless the context clearly dictates otherwise.

The present invention may be as defined in any one of the following numbered paragraphs.

1. A method for detecting an antibody against a pathogen in a subject, the method comprising:
    (a) contacting a reaction sample comprising a display library with a biological sample comprising antibodies, wherein the display library comprises a plurality of peptides derived from a plurality of pathogens, and
    (b) detecting a peptide bound to at least one antibody, thereby detecting an antibody capable of binding the peptide.
2. The method of paragraph 1, wherein the plurality of pathogens is a plurality of viruses, bacteria or fungi.
3. The method of paragraph 1 or 2, wherein the display library is a phage display library.
4. The method of paragraph 1, 2, or 3, wherein the antibodies in the reaction sample are immobilized.
5. The method of any one of the preceding paragraphs, wherein the antibodies are immobilized to a solid support adapted for binding IgM, IgA, or IgG subclasses.
6. The method of any one of the preceding paragraphs, wherein the antibodies are immobilized by contacting the display library and antibodies from the biological sample with Protein A and/or Protein G.
7. The method of any one of the preceding paragraphs, wherein the Protein A and/or Protein G are immobilized to a solid support.
8. The method of any one of the preceding paragraphs, comprising removing unbound antibody and peptides of the display library.
9. The method of any one of the preceding paragraphs, wherein the plurality of peptides are each less than 100, 200, or 300 amino acids long.
10. The method of any one of the preceding paragraphs, wherein the plurality of peptides are each less than 75 amino acids long.
11. The method of any one of the preceding paragraphs, wherein each peptide of the plurality of peptides comprises a common adapter region appended to the end of the nucleic acid sequence encoding the peptide.

12. The method of any one of the preceding paragraphs, wherein the detection of the antibody comprises a step of lysing the phage and amplifying the DNA.
13. The method of any one of the preceding paragraphs, wherein at least two antibodies are detected.
14. The method of any one of the preceding paragraphs, wherein the at least two antibodies are detected simultaneously.
15. The method of any one of the preceding paragraphs, wherein antibodies from the biological samples are immobilized.
16. A method for identifying a pathogen associated with a disease, the method comprising
    (a) obtaining a biological sample from a plurality of subjects having a common disease, wherein the common disease is suspected of having a pathogenic component,
    (b) separately contacting each sample of a plurality of reaction samples with each biological sample under conditions that allow formation of at least one antibody-peptide complex, wherein the reaction samples each comprise a display library comprising a plurality of peptides derived from a plurality of pathogens,
    (c) isolating the at least one antibody-peptide complex formed in each reaction sample from unbound phage,
    (d) correlating at least one peptide in the at least one antibody-peptide complex in each reaction sample to the pathogen from which it is derived, and
    (e) identifying a pathogen that is significantly enriched in the plurality of subjects with disease compared to subjects without the disease.
17. The method of paragraph 16, wherein the plurality of pathogens is a plurality of viruses, bacteria or fungi.
18. The method of paragraph 16 or 17, wherein the display library is a phage display library.
19. The method of paragraph 16, 17, or 18, wherein the antibodies in the reaction sample are immobilized.
20. The method of any one of paragraphs 16-19, wherein the antibodies are immobilized to a solid support adapted for binding IgM, IgA, or IgG subclasses.
21. The method of any one of paragraphs 16-20, wherein the antibodies are immobilized by contacting the display library and antibodies from the biological sample with Protein A and/or Protein G.
22. The method of any one of paragraphs 16-21, wherein the Protein A and/or Protein G are immobilized to a solid support.
23. The method of any one of paragraphs 16-22, wherein the plurality of peptides are each less than 100 amino acids long.
24. The method of any one of paragraphs 16-23, wherein the plurality of peptides are each less than 75 amino acids long.
25. The method of any one of paragraphs 16-24, wherein each peptide of the plurality of peptides comprises a common adapter region appended to the end of the nucleic acid sequence encoding the peptide.
26. The method of any one of paragraphs 16-25, wherein the detection of the at least one peptide in the at least one antibody-peptide complex comprises a step of lysing the phage and amplifying the DNA.
27. The method of any one of paragraphs 16-26, wherein at least two peptides are detected.
28. The method of any one of paragraphs 16-27, wherein the at least two peptides are detected simultaneously.

29. The method of any one of paragraphs 16-28, wherein the common disease comprises disease selected from the group consisting of: Kawasaki Disease, Bell's Palsy, Meniere's Disease, Type I diabetes, juvenile idiopathic arthritis, Chronic Fatigue Syndrome, Gulf War Illness, Myasthenia Gravis, and IgG4 disease.

30. The method of any one of the preceding paragraphs, further comprising identifying the epitope to which the antibody binds.

31. The method of any one of the preceding paragraphs, further comprising determining whether the antibody cross-reacts with an autoimmune antigen in the subject.

32. A method for improving vaccine design, the method comprising:
   (a) obtaining a biological sample from a plurality of subjects exposed to a pathogen,
   (b) separately contacting each sample of a plurality of reaction samples with each biological sample under conditions that allow formation of at least one antibody-peptide complex, wherein the reaction samples each comprise a display library comprising a plurality of peptides derived from a plurality of pathogens,
   (c) isolating the at least one antibody-peptide complex formed in each reaction sample from unbound phage,
   (d) correlating at least one peptide in the at least one antibody-peptide complex in each reaction sample to the pathogen from which it is derived, and
   (e) identifying an antigenic peptide that is significantly enriched in the plurality of subjects exposed to the pathogen as compared to subjects that have not been exposed to the pathogen for use in designing an improved vaccine.

33. The method of paragraph 32, wherein the plurality of pathogens is a plurality of viruses, bacteria or fungi.

34. The method of paragraph 32 or 33, wherein the display library is a phage display library.

35. The method of paragraph 32, 33 or 34, wherein the antibodies in the reaction sample are immobilized.

36. The method of any one of paragraphs 32-35, wherein the antibodies are immobilized to a solid support adapted for binding IgM, IgA, or IgG subclasses.

37. The method of any one of paragraphs 32-36, wherein the antibodies are immobilized by contacting the display library and antibodies from the biological sample with Protein A and/or Protein G.

38. The method of any one of paragraphs 32-37, wherein the Protein A and/or Protein G are immobilized to a solid support.

39. The method of any one of paragraphs 32-38, wherein the plurality of peptides are each less than 100, 200, or 300 amino acids long.

40. The method of any one of paragraphs 32-39, wherein the plurality of peptides are each less than 75 amino acids long.

41. The method of any one of paragraphs 32-40, wherein each peptide of the plurality of peptides comprises a common adapter region appended to the end of the nucleic acid sequence encoding the peptide.

42. The method of any one of paragraphs 32-41, wherein the detection of the antigenic peptide comprises a step of lysing the phage and amplifying the DNA.

43. The method of any one of paragraphs 32-42, wherein at least two peptides are detected.

44. The method of any one of paragraphs 32-43, wherein the at least two peptides are detected simultaneously.

45. A phage library displaying a plurality of viral peptides, wherein the plurality of viral peptides represent a set of peptides from viruses known to infect humans.

46. The phage library of paragraph 45, wherein the phage library comprises a plurality of viral peptides from at least 3 viruses known to infect humans.

47. The phage library of paragraph 45 or 46, wherein the phage library comprises a plurality of viral peptides from at least 10 viruses known to infect humans.

48. The phage library of paragraph 45, 46, or 47 wherein the phage library comprises a plurality of viral peptides from at least 20 viruses known to infect humans.

49. The phage library of any one of paragraphs 45-48, wherein the phage library comprises at least 10 peptide sequences.

50. The phage library of any one of paragraphs 45-49, wherein the phage library comprises at least 20 peptide sequences.

51. The phage library of any one of paragraphs 45-50, wherein the plurality of peptides are each less than 100, 200 or 300 amino acids long.

52. The phage library of any one of paragraphs 45-51, wherein the plurality of peptides are each less than 75 amino acids long.

53. The phage library of any one of paragraphs 45-52, wherein each peptide of the plurality of peptides comprises a common adapter region appended to the end of the nucleic acid sequence encoding the peptide.

54. The phage library of any one of paragraphs 45-53, wherein the plurality of peptides are immunodominant epitopes.

EXAMPLES

Example 1: Peptide Sequence Library Generation

Figure 1B:
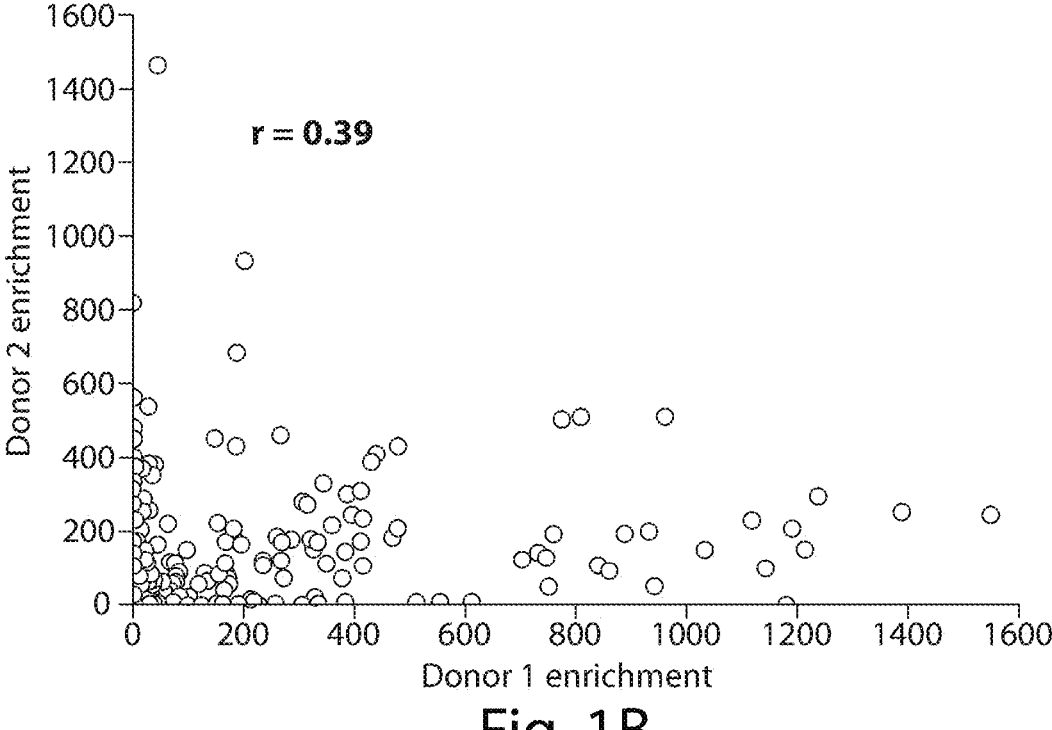
Figure 1C:
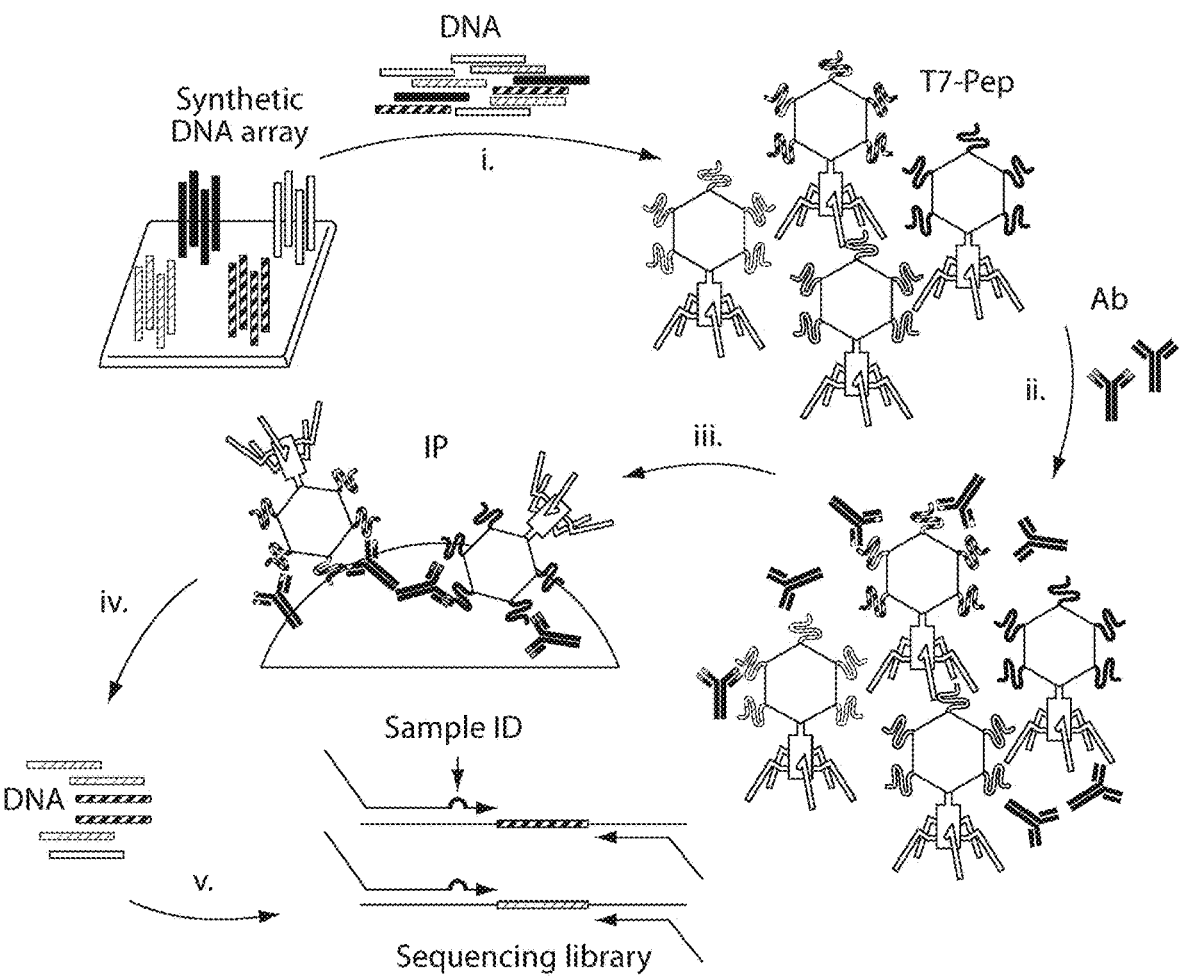

The general process is illustrated in FIG. 1C. Peptide sequences are back-translated into DNA sequences with randomized codon usage to minimize sequence redundancy in order to facilitate unique identification using short DNA reads. The DNA sequences were also edited using synonymous mutations to remove rare codons and restriction sites used for downstream cloning. Finally, a common "adapter" region was appended to the ends of each DNA sequence to allow PCR amplification of the library. The final set of defined DNA sequences were synthesized as oligonucleotides on a programmable DNA microarray, PCR amplified, and cloned into a commercially available T7-Select 10-3b display system using standard molecular biology techniques. The T7-Select 10-3b system produces peptides encoded by DNA as fusions to the exterior coat proteins of T7 bacteriophage particles. Each bacteriophage particle contains DNA encoding a peptide fused to the C-terminus of the T7 gene 10 protein. The exterior of the bacteriophage particle is surrounded by 415 copies of the gene 10 protein; on average, 5-15 of these copies will contain the C-terminal peptide fusion.

Example 2: Immobilization Steps

One can mix this set of modified bacteriophage with a sample containing antibodies. Any antiviral antibodies in the sample will bind to bacteriophage that display the cognate antigen. After a period of mixing, one adds in micron-sized magnetic beads coated with Protein A and Protein G. Protein A and G will bind to antibodies in the mixture and immobilize them on the beads. This process also immobilizes any phage particles bound by the antibodies. After another period of mixing, one can use a magnet to separate the immobilized phage from unbound phage.

Example 3: Phage Lysis and Signal Reading

Then, phage are lysed by heat denaturation and PCR is applied to amplify the DNA region corresponding to the displayed peptide sequence. This PCR primer contains a common adapter sequence which can be amplified in a second PCR reaction by another set of primers to prepare the DNA for Illumina high throughput sequencing. Unique barcoded oligonucleotides in the second PCR reaction amplify different samples and pool them together in one sequencing run for cost reduction.

To distinguish various signal reads, a set of custom Python scripts are applied to count the frequency of each peptide in each barcoded sample, and custom statistical analysis is applied to identify which peptides are significantly enriched by the selection. One can then determine which peptide epitopes are being recognized by antibodies in those samples.

Example 4: Detection of Viral Antibodies

As a preliminary test, the Inventors performed a pull-down using a commercial HA antibody, which recognizes an epitope of influenza haemagglutinin. Results are shown in FIGS. 1A and 1B. Importantly, using the described systems and methods, the Inventors were able to confirm 10 to 100-fold enrichment of at least two out of eight peptides in the library that contain the HA epitope. In a pilot study of donor antibody repertoires, the Inventors discovered that the viral peptides enriched by donor serum are highly reproducible. Sera from different donors, on the other hand, recognize distinct profiles of peptides presumably commensurate with their previous unique histories of viral exposure.

Figure 2:
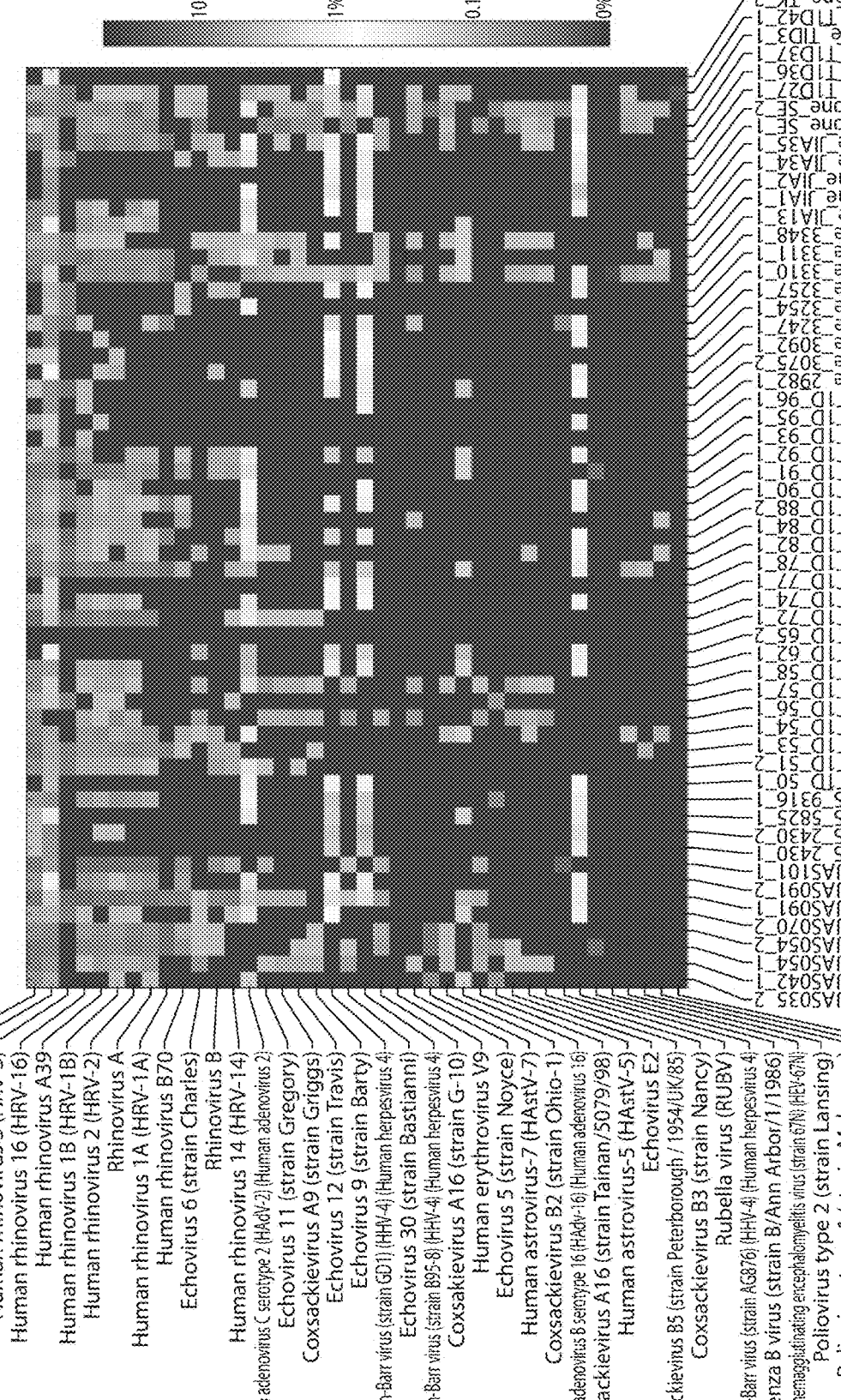
FIG. 2 is a heatmap showing the distribution of responses to viruses across different patient samples. The percentage of peptides from a particular virus that were determined to be significantly enriched in that particular sample.

A pattern of strong enrichment of peptide epitopes from a single virus indicates the sample donor is or was infected with that virus. In the described study, the Inventors observed that the vast majority of donors have strong responses against common viruses such as Rhinovirus (common cold), while fewer patients have strong responses against rarer viruses such as Human erythrovirus V9 or Simian adenovirus (FIG. 2).

Example 5: Detection of Cross-Reactive Antigens Related to Autoimmunity

Figure 3A:
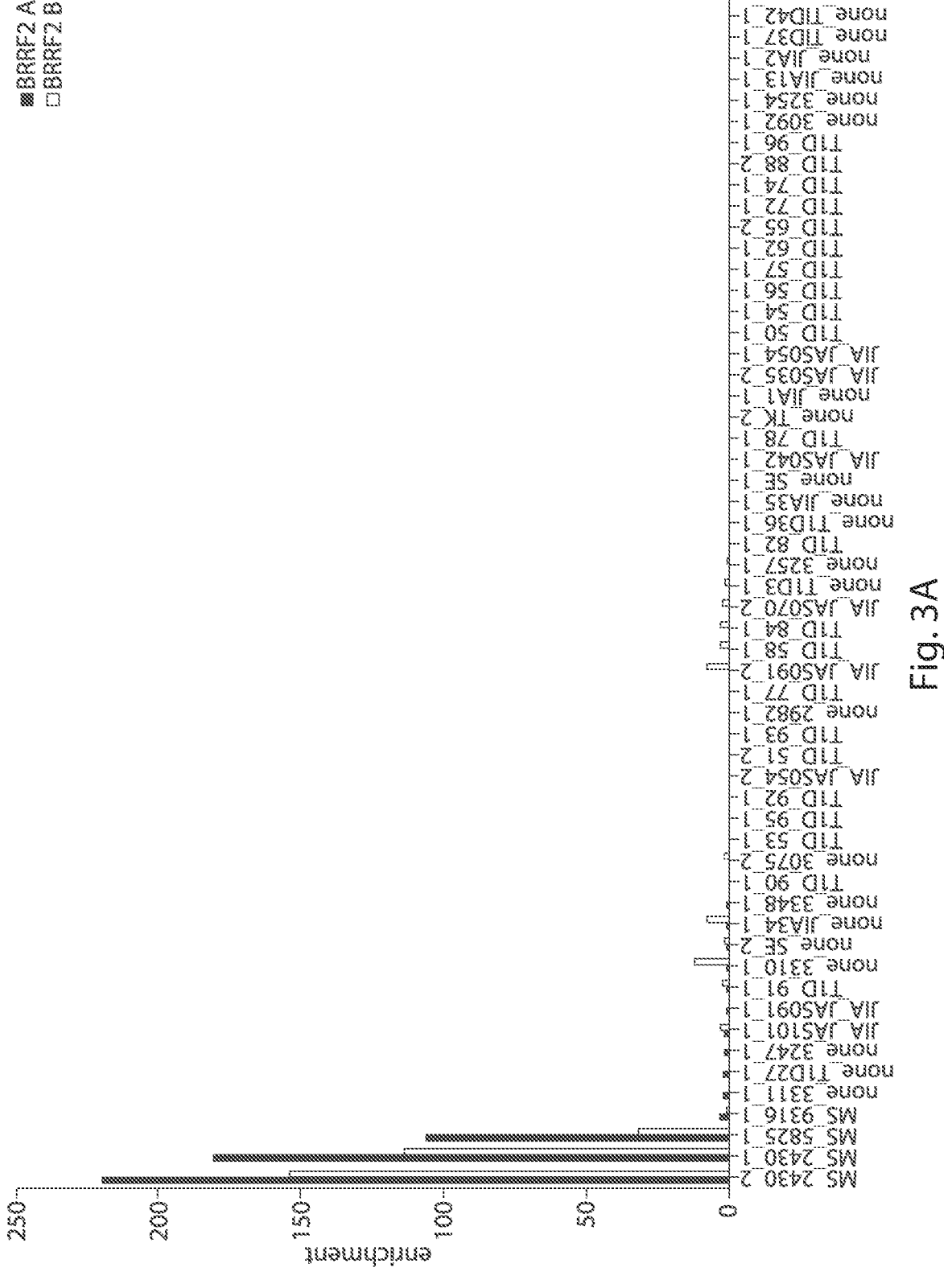

As positive confirmation of the described systems and methods, the Inventors identified a known epitope in the EBV BRRF2 protein that is cross-reactive with autoimmune antigens in patients with multiple sclerosis (FIG. 3). This technology can be used to identify other such epitopes in diseases with suspected viral etiology. Particular peptide epitope responses can be important in providing protective immunity against reinfection. The described systems and methods can therefore be applied to determine common antiviral antibody responses in people immunized against viruses in order to improve vaccine design.

Example 6: VirScan

Summary: The human virome plays important roles in host health and immunity. However, current methods for detecting viral infections and antiviral responses have limited throughput and coverage. Described herein is the inventors' "VirScan", a high-throughput method to comprehensively analyze viral infection and antibody response using immunoprecipitation and massively parallel DNA sequencing of a bacteriophage library displaying peptides from all known human virus species. The inventors assayed over 106 million antibody-viral peptide interactions in 569 humans across four different continents, nearly doubling the number of previously established viral epitopes. In this cohort the inventors detected immune responses in sera to an average of 10 species of viruses per person and a total of 87 species in at least two individuals. It was determined that although rates of specific virus exposure are heterogeneous across populations, human antibody responses target strikingly conserved epitope cohorts for each virus, indicating that these broadly immunogenic epitopes elicit highly similar antibodies across individuals. The results described herein indicate that VirScan is a powerful approach for studying interactions between the virome and the immune system.

Background: Emerging evidence indicates that the collection of viruses found to infect humans (the "human virome") can have profound effects on human health (1). In addition to directly causing acute or chronic illness, each virus leaves an indelible footprint in the host. Viral infection permanently alters the immune system and can also alter host immunity in more subtle ways (2). For example, latent herpesvirus infection has been shown to confer symbiotic protection against bacterial infection in mice through prolonged production of interferon-γ and systemic activation of macrophages (3). This interplay between virome and host immunity has also been implicated in the pathogenesis of complex diseases such as type 1 diabetes, inflammatory bowel disease, and asthma (4). Despite this growing appreciation for the importance of interactions between the virome and host, a comprehensive method to systematically characterize these interactions has yet to be developed (5).

The advent of high-throughput DNA sequencing has ushered in a new era of unbiased viral nucleic acid detection (6). However, nucleic acid tests fail in cases where viruses have already been cleared after causing or initiating tissue damage and can miss viruses of low abundance or viruses not normally present in the sampled fluid or surface. In contrast, humoral responses to infection typically arise within two weeks of initial exposure and can persist over years or decades (7). Tests detecting antiviral antibodies in peripheral blood can therefore identify ongoing and cleared infections. However, current serological methods are predominantly limited to testing one virus at a time and are therefore only employed to address specific clinical hypotheses. Scaling serological analyses to encompass the complete human virome poses significant technical challenges, but would be of great value for better understanding host-virus interactions, and would overcome many of the limitations associated with current clinical technologies.

Described herein is VirScan, a novel technology that leverages recent advances in programmable DNA microarray technology to create a synthetic representation of the human virome (FIG. 1C). Immunoprecipitation and massively parallel DNA sequencing were used to comprehensively analyze the binding of an individual's antibodies to peptides in this synthetic human virome. VirScan is thus able to characterize the full spectrum of viral peptide epitopes targeted by an individual's B cell response. By testing a large number of individuals that are known to have viral infections detected by classical methods, it was confirmed that this platform identifies antiviral responses with very high sensitivity and specificity. Characterization of 569 serum samples revealed known and novel differences in viral exposure between populations of differing age, HIV status, and geographic location. Finally, the inventors employed VirScan to identify the specific B cell epitope determinants targeted and found remarkable similarity in epitope recognition across individuals and populations. These findings establish VirScan as a powerful new approach for studying interactions between the human virome and the immune system in health and disease.
Results
The VirScan Platform VirScan utilizes the Phage Immunoprecipitation sequencing (PhIP-seq) technology as previously described (8). Briefly, the inventors used a programmable DNA microarray to synthesize 93,904 200-mer oligonucleotides, encoding 56-residue peptide tiles, with 28 residue overlaps, that together span the reference protein sequences (collapsed to 90% identity) of all viruses annotated to have human tropism in the UniProt database (9). This library includes peptides from 206 species of virus and over 1,000 different strains. The library was cloned into a T7 bacteriophage display vector for screening.

To perform a screen, one of skill in the art will incubate the library with a serum sample containing antibodies, recover the antibodies using a mixture of protein A and G coated magnetic beads, and remove unbound phage particles by washing. Finally, one will perform PCR and massively parallel DNA sequencing on the phage inserts to quantify enrichment of each library member due to antibody binding. Each sample is screened in duplicate to ensure reproducibility. VirScan requires only 2 µg of immunoglobulin (<1 µL of serum) per sample and can be automated on a 96-well liquid handling robot (10). PCR product from 96 immunoprecipitations can be individually barcoded and pooled for sequencing, reducing the cost for a comprehensive viral Ab screen to approximately $25 per sample.

Figure 4A:
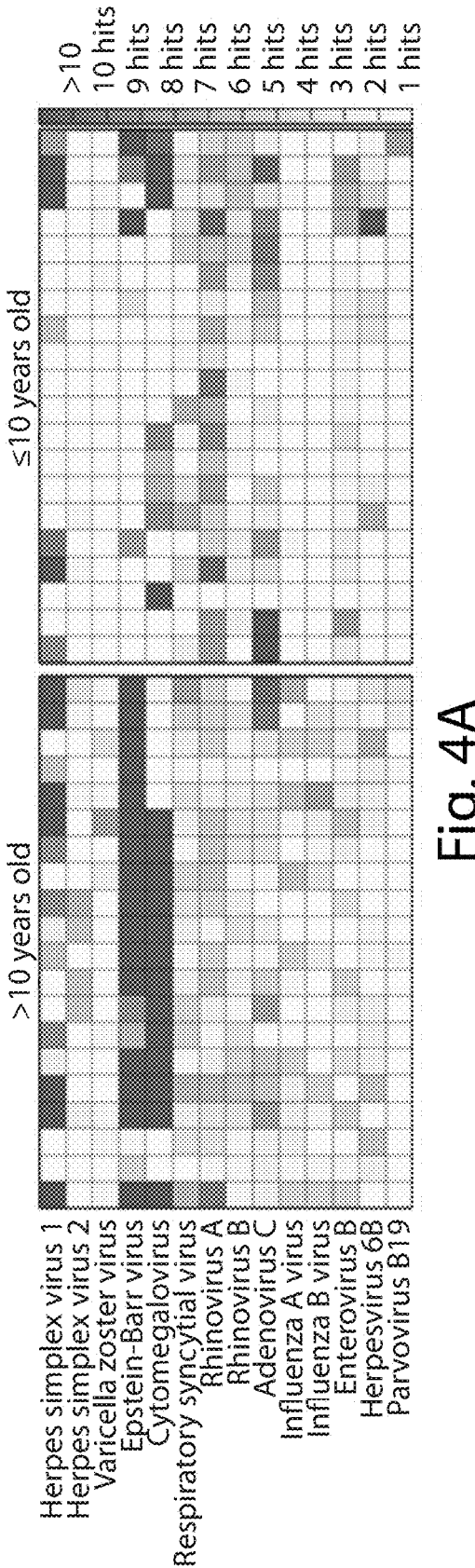
FIGS. 4A-4E show a general VirScan analysis of the human virome. The virome peptide library consists of 93,904 56 amino acid peptides tiling, with 28 amino acid overlap, across the proteomes of all known human viruses. 200 nt DNA sequences encoding the peptides were printed on a releasable DNA microarray. The released DNA was amplified and cloned into a T7 phage display vector and packaged into virus particles displaying the encoded peptide on its surface. The library is mixed with a sample containing antibodies that bind to their cognate peptide antigen on the phage surface. The antibodies are immobilized and unbound phage are washed away. Finally, amplification of the bound DNA and high throughput sequencing of the insert DNA from bound phage reveals peptides targeted by sample antibodies. Abbreviations: aa, amino acid; Ab, antibody; IP: immunoprecipitation.
Figure 8:
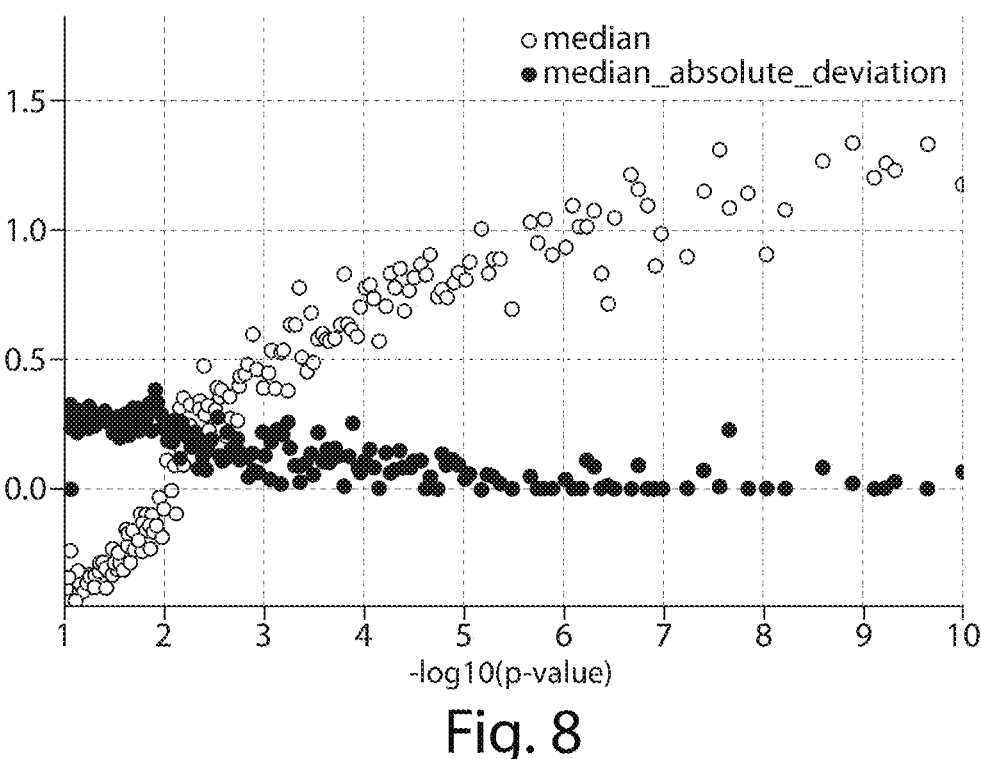
FIG. 8 Reproducibility threshold. Scatterplot for median and median absolute deviation of replicate 2–$\log_{10}$(p-values) whose replicate 1–$\log_{10}$(p-value) falls within the window whose left edge is shown on the horizontal axis.
Figure 9:
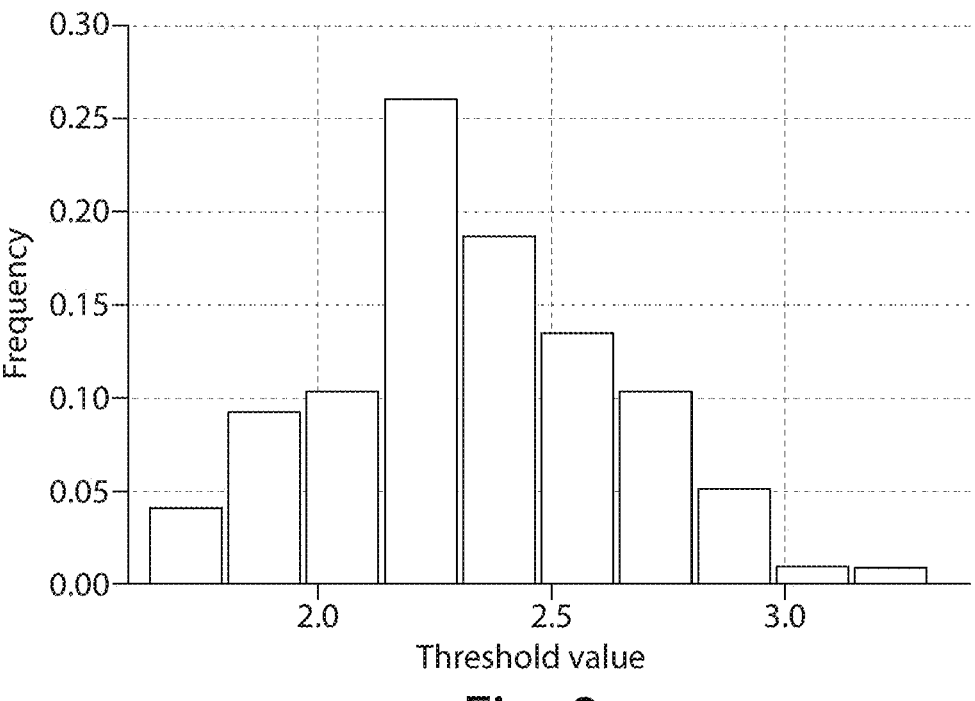
FIG. 9 Distribution of reproducibility threshold –$\log_{10}$(p-values). Histogram of the frequency of the reproducibility threshold –$\log_{10}$(p-values). The mean and median of the distribution are both approximately 2.3.

Following sequencing, the inventors tally the read count for each peptide before ("input") and after ("output") immunoprecipitation. The inventors then fit a zero-inflated generalized Poisson model to the distribution of output read counts for each input read count and regress the parameters as a function of input read count (FIG. 8). Using this model, a $-\log_{10}$(p-value) for the significance of each peptide's enrichment is calculated. Finally, a peptide is determined to be "significantly enriched" if its $-\log_{10}$(p-value) is greater than the reproducibility threshold of 2.3 in both replicates (FIG. 9).
VirScan is Highly Sensitive and Specific FIG. 4a shows the antibody profiles of a set of human viruses in sera from a typical group of individuals in a heat map format that illustrates the number of enriched peptides from each virus. The inventors frequently detected antibodies to multiple peptides from common human viruses, such as Epstein-Barr virus (EBV), Cytomegalovirus (CMV), and rhinovirus. As expected, more peptides were observed to be enriched from viruses with larger proteomes, such as EBV and CMV, likely because there are more epitopes available for recognition. The inventors noticed fewer enriched peptides in samples from individuals less than ten years of age compared to their geographically matched controls, in line with an accumulation of viral infections throughout adolescence and adulthood. However, there were occasional samples from young donors with very strong responses to viruses that cause childhood illness, such as Parvovirus B19 and Herpesvirus 6B, which cause the "fifth disease" and "sixth disease" of the classical infectious childhood rashes, respectively (11). These observations are examined in greater detail in FIG. 5.

A computational method was developed to identify the set of viruses to which an individual has been exposed, based on the number of enriched peptides identified per virus. Briefly, the inventors set a threshold number of significant non-overlapping peptide enrichments for each virus. The inventors empirically determined that a threshold of three non-overlapping enriched peptides gave the best performance for detecting Herpes simplex virus 1 compared to a commercial serologic test, described below (Table 1).

TABLE 1

Virscan is highly sensitive and specific. Sensitivity is the percentage of samples positive for the virus as determined by VirScan out of all n known positives. Specificity is the percentage of samples negative for the virus by VirScan out of all n known negatives.

| Virus | Sensitivity (n) | Specificity (n) |
|---|---|---|
| Hepatitis C virus | 93% (26) | 97%* (31) |
| Human immunodeficiency virus 1 | 93% (61) | 97%** (31) |
| Herpes simplex virus 1 | 97% (38) | 100% (6) |
| Herpes simplex virus 2 | 90% (20) | 100% (24) |

*The one false negative was from an individual whose HCV-negative status was self-reported, but had antibodies to as many HCV peptides as 23% of the true HCV positive individuals and is likely to be HCV positive now or in the past. It is possible that this individuals was exposed to HCV but cleared the infection. If true, the observed specificity for HCV is 100%.
**The one false positive was from an individual whose HIV-negative status was self-reported, but had antibodies to as many HIV peptides as 68% of the true HIV positive individuals and was very likely to be HIV positive. If true, the observed specificity for HIV is 100%.

Figure 10:
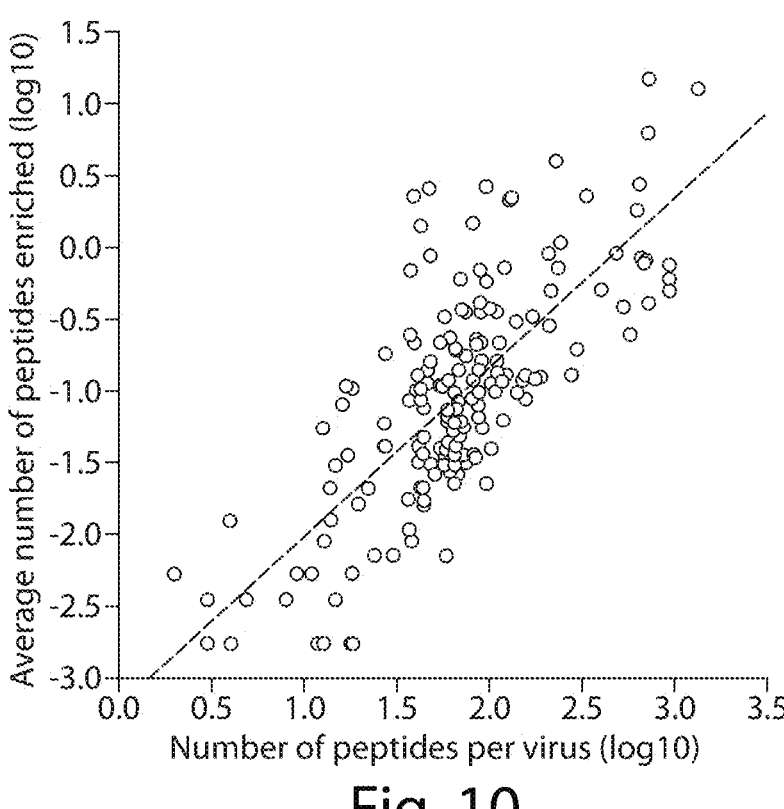
FIG. 10 Correlation between virus size and number of enriched peptides. Each dot on this log-log scatterplot is a virus. The horizontal axis corresponds to the size of the virus in number of peptides. The vertical axis corresponds to the average number of peptides enriched from the virus across all samples tested. The dashed line is a least-squares best-fit curve for the data.

For other viruses, the inventors adjusted the threshold to account for the size of the viral proteome (FIG. 10). Next, the number of enriched peptides from each virus was tallied. Antibodies generated against a specific virus can cross-react with similar peptides from a related virus. This would lead to false positives because an antibody targeted to an epitope from one virus to which a donor was exposed would also enrich a homologous peptide from a related virus to which the donor may not have been exposed. In order to address this issue, the inventors adopted a maximum parsimony approach to infer the fewest number of virus exposures that could elicit the observed spectrum of antiviral peptide antibodies. For groups of enriched peptides that share a 7 amino acid subsequence and may be recognized by a single specific antibody, the inventors only count it as one epitope for the virus which has the greatest number of other enriched peptides. If this adjusted peptide count is greater than the threshold for that virus, the sample is considered positive for the virus.

Using this analytical framework, the inventors measured the performance of VirScan using serum samples from patients known to be infected or not infected with human immunodeficiency virus (HIV) and Hepatitis C virus (HCV), based on commercial Elisa and WB assays. For both viruses, VirScan achieves very high sensitivities and specificities of ~95% or higher (Table 1). The viral genotype was also known for the HCV samples. Despite the very high sequence similarity among HCV genotypes (12), which poses a problem for all antibody-based detection methods, VirScan correctly reported the HCV genotype in 72% of the samples. The inventors also compared VirScan to a commercially available serology test that is type specific for the highly related Herpes simplex viruses 1 and 2 (HSV1 and HSV2). Again, despite sequence similarity between these viruses, VirScan is extremely specific and sensitive (Table 1). These results demonstrate that VirScan performs well in distinguishing between closely related viruses. The data also demonstrate that VirScan can detect antibodies to viruses that range in size from small (HIV and HCV) to very large (HSV1 and HSV2) with high sensitivity and specificity.

Population-Level Analysis of Viral Exposures

Figure 4B:
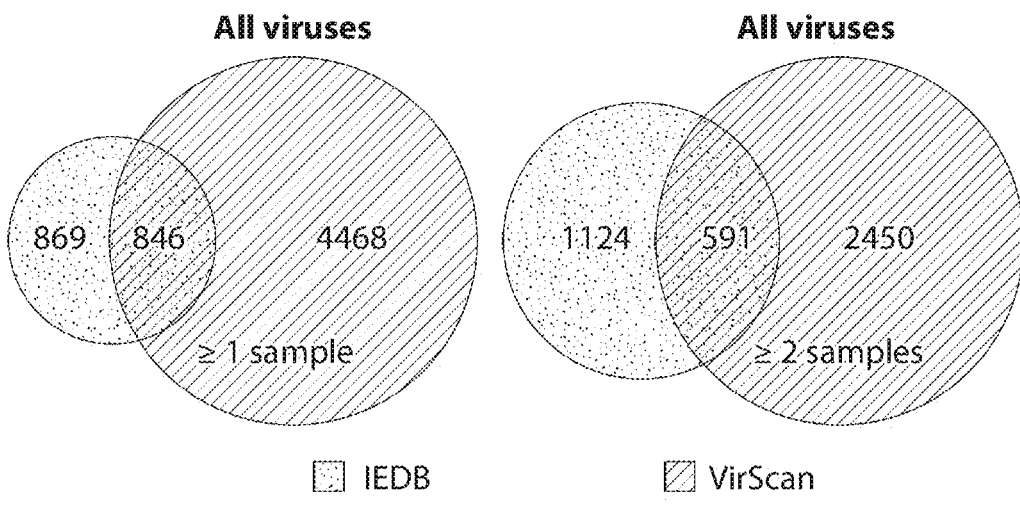
Figure 4C:
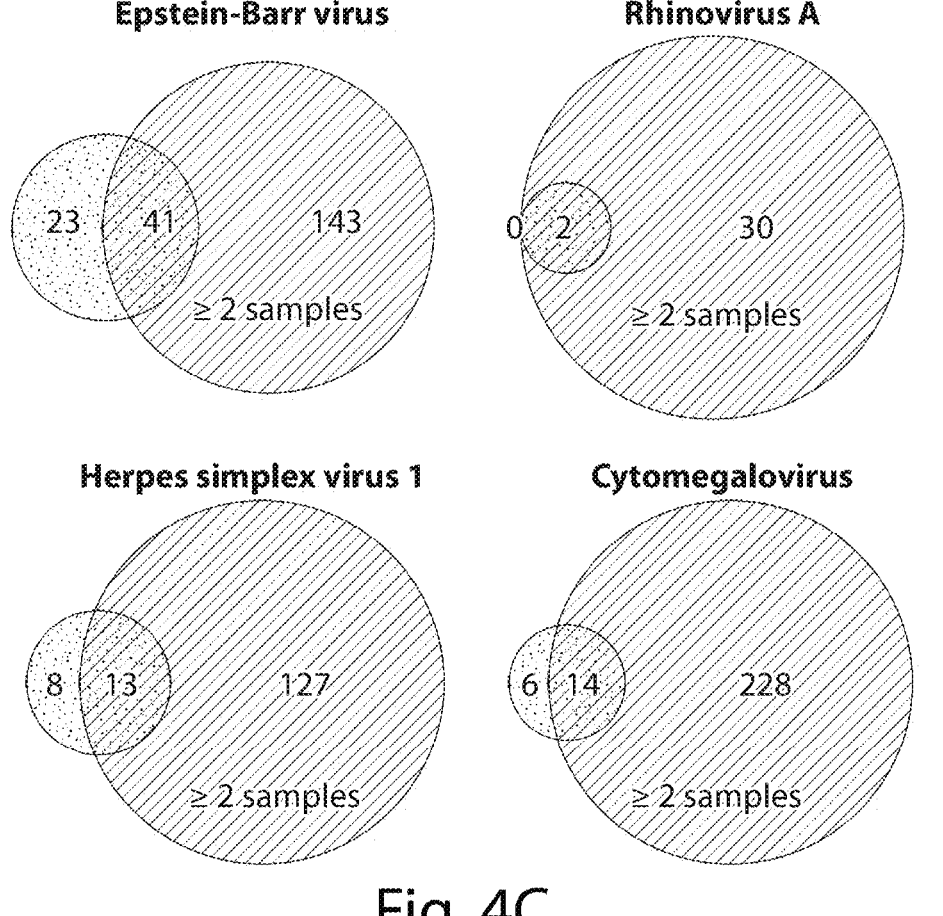
Figures 4D, 4E:
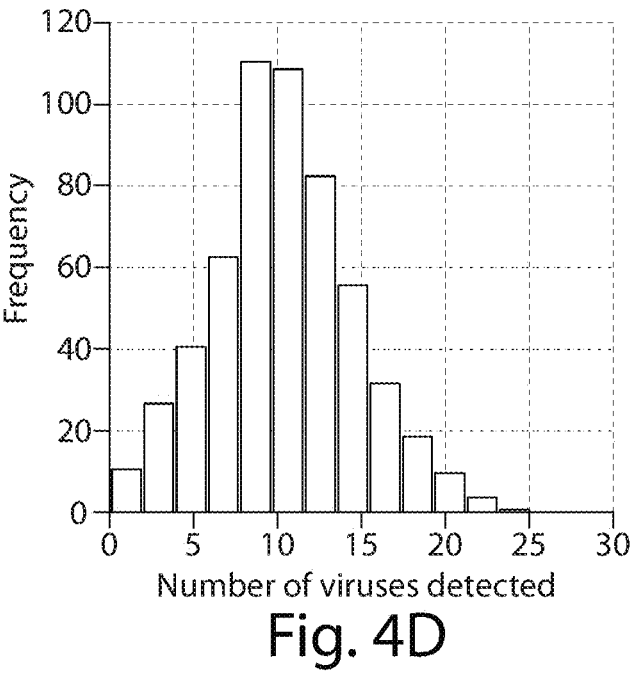

After ascertaining the high accuracy of VirScan for a panel of viruses, the inventors undertook a large-scale screening of samples that lacked any annotation of exposure history. Using our multiplex approach, 106 million antibody-peptide interactions were assayed using samples from 569 human donors in duplicate. Antibody responses were detected to an average of 10 species of virus per sample (FIG. 4D). Each person is likely exposed to multiple distinct strains of some viral species. These results are the first such estimate. Antibody responses to 65 of the 206 species of virus in the library were detected in at least 5 individuals, and 87 species in at least 2 individuals (Table 2).

TABLE 2

Prevalence of all viruses detected in donors residing in the United States. Known HIV-positive and HCV-positive samples were excluded from this analysis.

| Virus | % |
|---|---|
| Epstein-Barr virus | 88.1 |
| Rhinovirus B | 75.2 |
| Human adenovirus C | 74.6 |
| Rhinovirus A | 73.9 |
| Human respiratory syncytial virus | 68.0 |
| Influenza A virus | 58.4 |
| Human herpesvirus 6B | 57.1 |
| Herpes simplex virus 1 | 54.1 |
| Cytomegalovirus | 49.8 |
| Influenza B virus | 42.2 |
| Enterovirus C | 37.3 |
| Varicella zoster virus | 24.4 |
| Human adenovirus F | 22.1 |
| Human adenovirus B | 17.5 |
| Herpes simplex virus 2 | 16.5 |
| Enterovirus A | 16.5 |
| Enterovirus B | 11.9 |
| Norwalk virus | 11.6 |
| Mamastrovirus 1 | 11.2 |
| Human herpesvirus 7 | 10.2 |
| Human parainfluenza virus 3 | 9.6 |
| Human adenovirus D | 8.6 |
| Cowpox virus | 7.6 |
| Human adenovirus A | 6.9 |
| Human metapneumovirus | 6.3 |
| Human coronavirus HKU1 | 5.6 |
| Influenza C virus | 4.6 |
| Hepatitis B virus | 4.6 |
| Human parvovirus B19 | 4.3 |
| Human herpesvirus 6A | 4.0 |
| Aichivirus A | 4.0 |
| Alphapapillomavirus 9 | 3.6 |
| Rubella virus | 3.3 |
| Hepatitis E virus | 2.6 |
| Human herpesvirus 8 | 2.3 |
| Betapapillomavirus 1 | 2.3 |
| Rotavirus A | 2.0 |
| Human parainfluenza virus 4 | 2.0 |
| Torque teno virus | 1.7 |

TABLE 2-continued

Prevalence of all viruses detected in donors residing in the United States. Known HIV-positive and HCV-positive samples were excluded from this analysis.

| Virus | % |
|---|---|
| Measles virus | 1.7 |
| Human coronavirus NL63 | 1.7 |
| Hepatitis C virus | 1.7 |
| Eastern equine encephalitis virus | 1.7 |
| Tanapox virus | 1.3 |
| Rotavirus C | 1.3 |
| Betapapillomavirus 2 | 1.3 |
| Alphapapillomavirus 7 | 1.3 |
| Alphapapillomavirus 11 | 1.3 |
| Alphapapillomavirus 10 | 1.3 |
| Venezuelan equine encephalitis virus | 1.0 |
| SARS-related coronavirus | 1.0 |
| Ross River virus | 1.0 |
| Human parainfluenza virus 1 | 1.0 |
| Human adenovirus E | 1.0 |
| Betacoronavirus 1 | 1.0 |
| Yaba monkey tumor virus | 0.7 |
| Variola virus | 0.7 |
| Torque teno mini virus 1 | 0.7 |
| Rotavirus B | 0.7 |
| Lagos bat virus | 0.7 |
| Human coronavirus 229E | 0.7 |
| Hepatitis A virus | 0.7 |
| Dugbe virus | 0.7 |
| Dengue virus | 0.7 |
| Chikungunya virus | 0.7 |
| Bat coronavirus 1B | 0.7 |
| Alphapapillomavirus 1 | 0.7 |
| Yellow fever virus | 0.3 |
| Vesicular stomatitis Indiana virus | 0.3 |
| Vaccinia virus | 0.3 |
| Uukuniemi virus | 0.3 |
| Torque teno midi virus 1 | 0.3 |
| Orf virus | 0.3 |
| Monkeypox virus | 0.3 |
| Molluscum contagiosum virus | 0.3 |
| Marburg marburgvirus | 0.3 |
| Macacine herpesvirus 1 | 0.3 |
| KI polyomavirus | 0.3 |
| JC polyomavirus | 0.3 |
| Isfahan virus | 0.3 |
| Human parainfluenza virus 2 | 0.3 |
| Human immunodeficiency virus 2 | 0.3 |
| Getah virus | 0.3 |
| Enterovirus D | 0.3 |
| Cercopithecine herpesvirus 2 | 0.3 |
| Bunyamwera virus | 0.3 |
| Banna virus | 0.3 |
| Australian bat lyssavirus | 0.3 |
| Alphapapillomavirus 3 | 0.3 |
| Alphapapillomavirus 2 | 0.3 |
| Alphacoronavirus 1 | 0.3 |

The most frequently detected viruses are generally those known to commonly infect humans (FIG. 4E). The inventors occasionally detected what appear to be false positives that may be due to antibodies that cross react with non-viral peptides. For example, over 43% of the samples positive for Cowpox virus were right at the threshold of detection and had antibodies against a peptide from the C4L gene that shares an eight amino acid sequence ('SESDSDSD') (SEQ ID NO: 1) with the Clumping Factor B protein from *Staphylococcus aureus*, which humans are known to generate antibodies against (13). This will become less of an issue as the inventors test more examples of sera from patients with known infections to determine the set of likely immunogenic peptides for a given virus. The inventors frequently detected antibodies to rhinovirus and respiratory syncytial virus, which are normally found only in the respiratory tract, indicating that VirScan using blood samples is still able to detect viruses that do not cause viremia. Antibodies to influenza, which is normally cleared, and poliovirus were also detected, which in modern times most people generate antibodies through vaccination. Since the original antigen is no longer present, the inventors are likely detecting antibodies secreted by long-lived memory B cells (14).

The frequency at which influenza (58.4%) and poliovirus (37.3%) was detected is lower than expected given that the majority of the population has been exposed to or vaccinated against these viruses. This may be due to reduced sensitivity because of a gradual narrowing and decrease of the long-lived B cell response in the absence of persistent antigen. The frequency of detecting varicella zoster virus (chicken pox) antibodies is also lower than expected (24.4%), even though the frequency of detecting other latent herpesviruses, such as Epstein-Barr virus (88.1%) and cytomegalovirus (49.8%), is similar to the prevalence reported in epidemiological studies (15-17). Without wishing to be bound by theory, this may reflect differences in how frequently these viruses shed antigens that stimulate B cell responses or a more limited humoral response that relies on epitopes that cannot be detected in a 56 residue peptide. It might be possible to increase the sensitivity of detection of these viral antibodies by stimulating memory B cells in vitro to probe the history of infection more deeply.

Figure 5A:
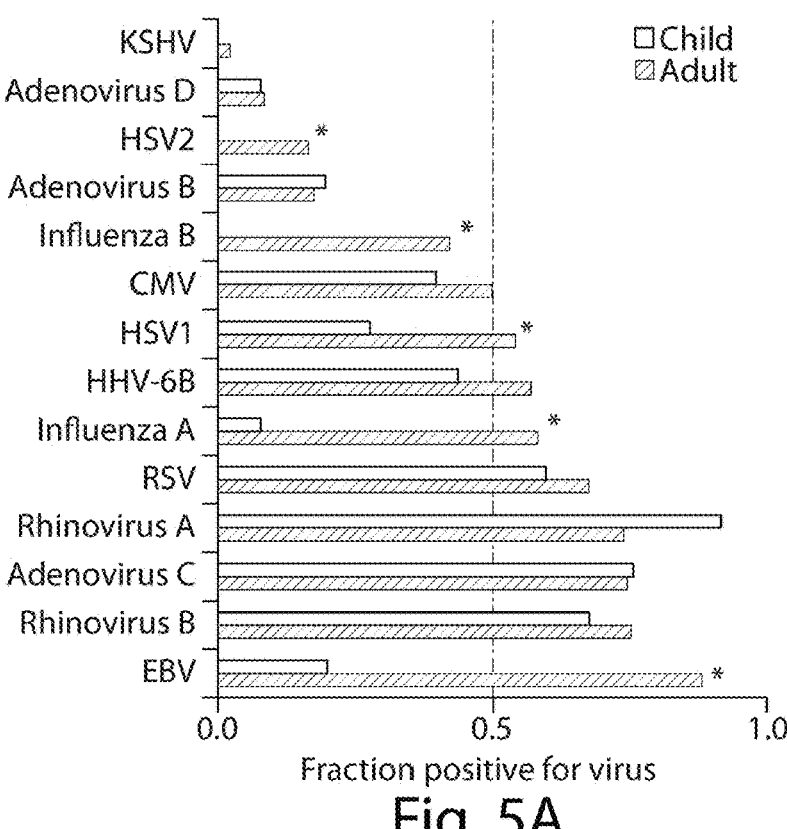

To assess differences in viral exposure between populations, the inventors split the samples into different groups based on age, HIV status, and geography. Results were first compared from children under the age of ten to adults within the United States (HIV-positive individuals were excluded from this analysis) (FIG. 5A). Fewer children were positive for most viruses, including Epstein-Barr virus, HSV1, HSV2, and influenza virus, which is consistent with our preliminary observations comparing the number of enriched peptides (FIG. 4A). Even though children may generate lower antibody titers in general, the data are in line with these younger donors probably have not yet been exposed to many of these viruses, for example HSV2 which is sexually transmitted (18).

Figure 5B:
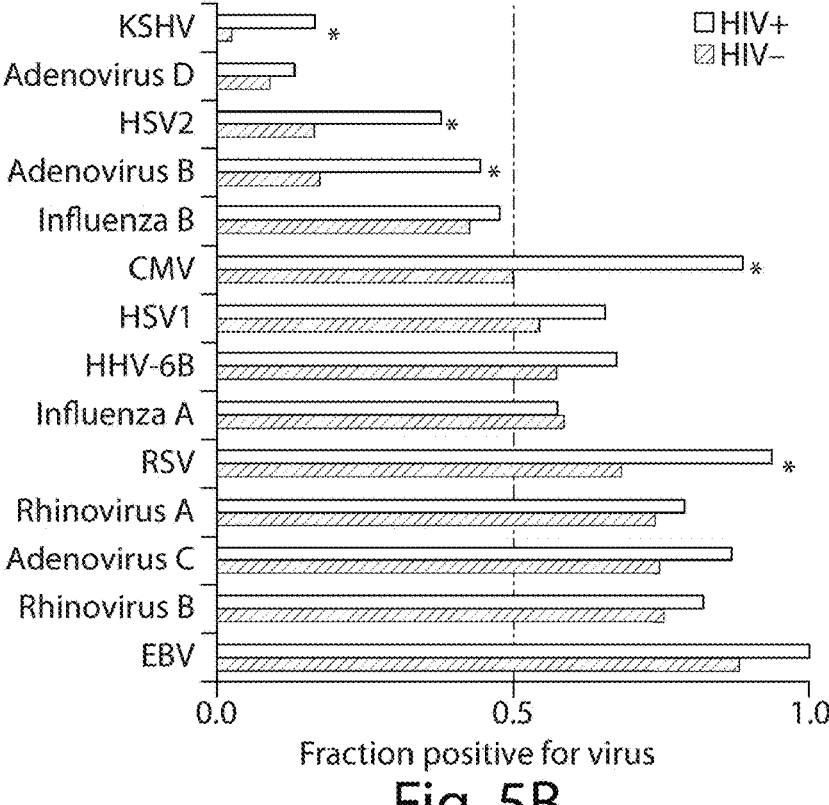

When comparing results from HIV positive to HIV negative samples, the inventors found more of the HIV positive samples to also be seropositive for additional viruses, including HSV2, CMV, and Kaposi's sarcoma-associated herpesvirus (KSHV) (false discovery rate q<0.05, FIG. 5B). These results are consistent with prior studies indicating higher risk of these co-infections in HIV positive patients (19-21). Without wishing to be bound by theory, the patients with HIV may engage in activities that put them at higher risk for exposure to these viruses. Alternatively, these viruses may increase the risk of HIV infection.

Finally, the inventors compared the evidence of viral exposure between samples taken from adult HIV-negative donors residing in countries from four different continents (the United States, Peru, Thailand, and South Africa). In general, donors outside the United States had higher frequencies of seropositivity (FIGS. 5C-5E). For example, cytomegalovirus antibodies were found in significantly higher frequencies in samples from Peru, Thailand, and South Africa. Other viruses, such as Kaposi's sarcoma-associated herpesvirus and HSV1 were detected more frequently in donors from Peru and South Africa, but not Thailand. The observed seroprevalence of different adenovirus species varies across populations. Adenovirus C seropositivity was found at similar frequencies in all regions, but Adenovirus D seropositivity was generally higher outside the United States, while Adenovirus B seropositivity was higher in Peru and South Africa, but lower in Thailand. Without wishing to be bound by theory, the higher rates of virus exposure outside the United States could be due to differences in population density, cultural practices, sanitation, or genetic susceptibility. Interestingly, Influenza B seropositivity was more common in the United States compared to other countries, especially Thailand. The incidence of Influenza B is much lower than Influenza A but the standard flu vaccination contains both Influenza A and B strains, so the elevated frequency of individuals with seroreactivity may be due to higher rates of flu vaccination in the United States. Other viruses, such as Rhinovirus and Epstein-Barr virus, were detected at very similar frequencies in all the geographic regions.

Analysis of Viral Epitope Determinants

Figure 11A:
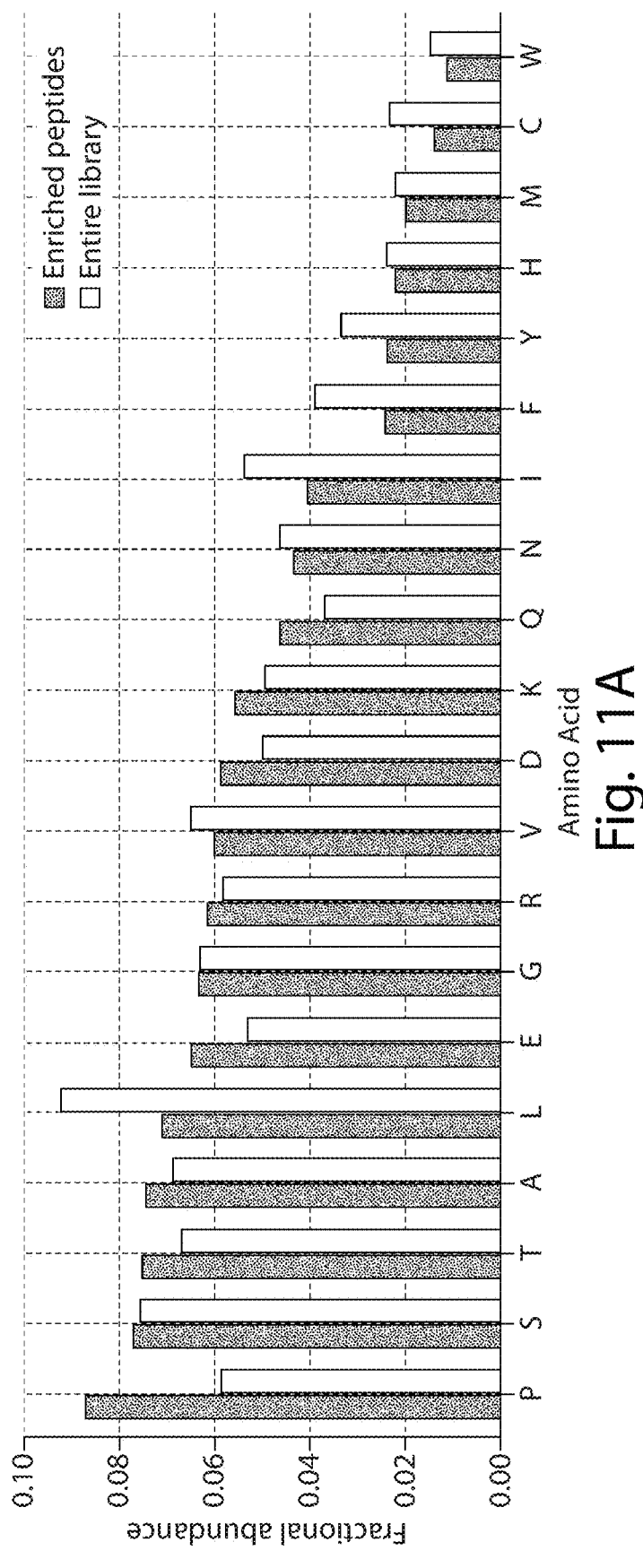
FIGS. 11A-11B Amino acid composition of enriched peptides.
Figure 11B:
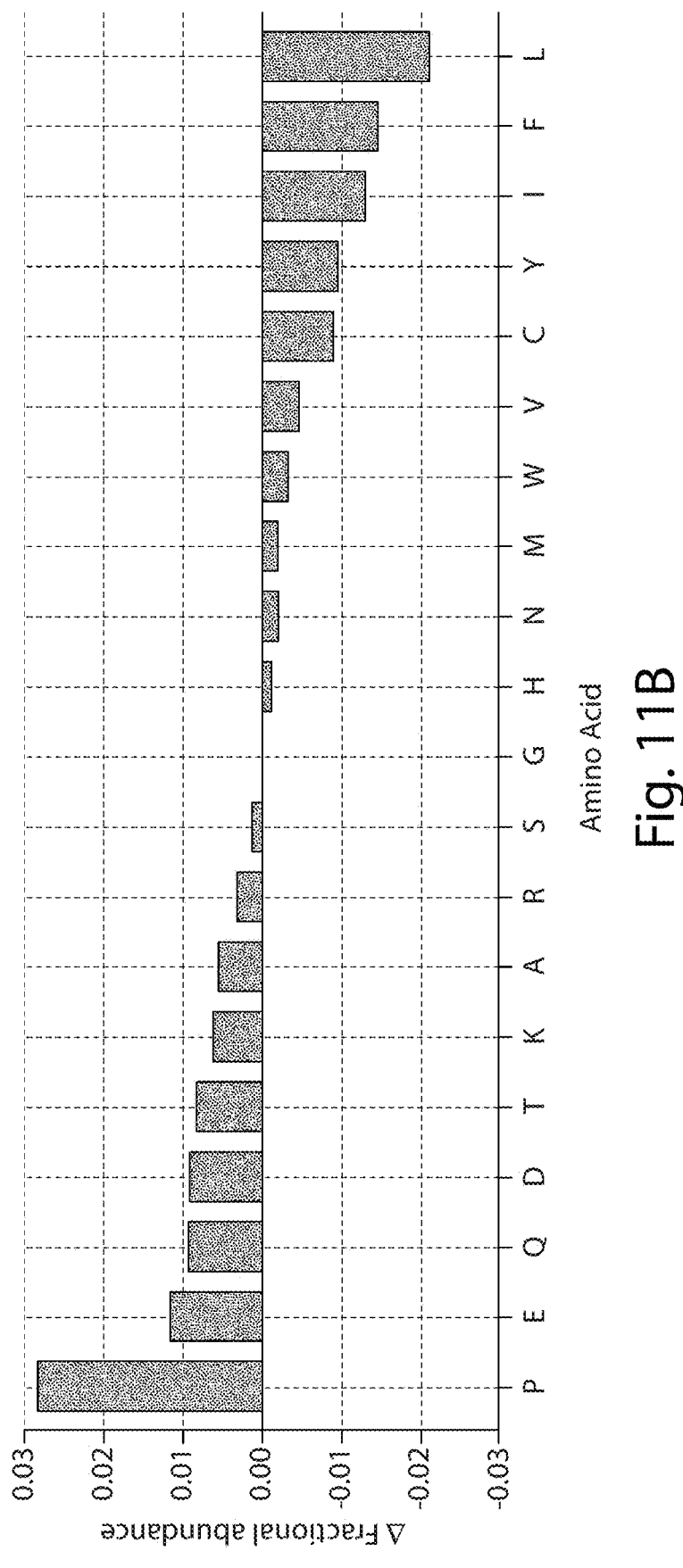
Figure 12A:
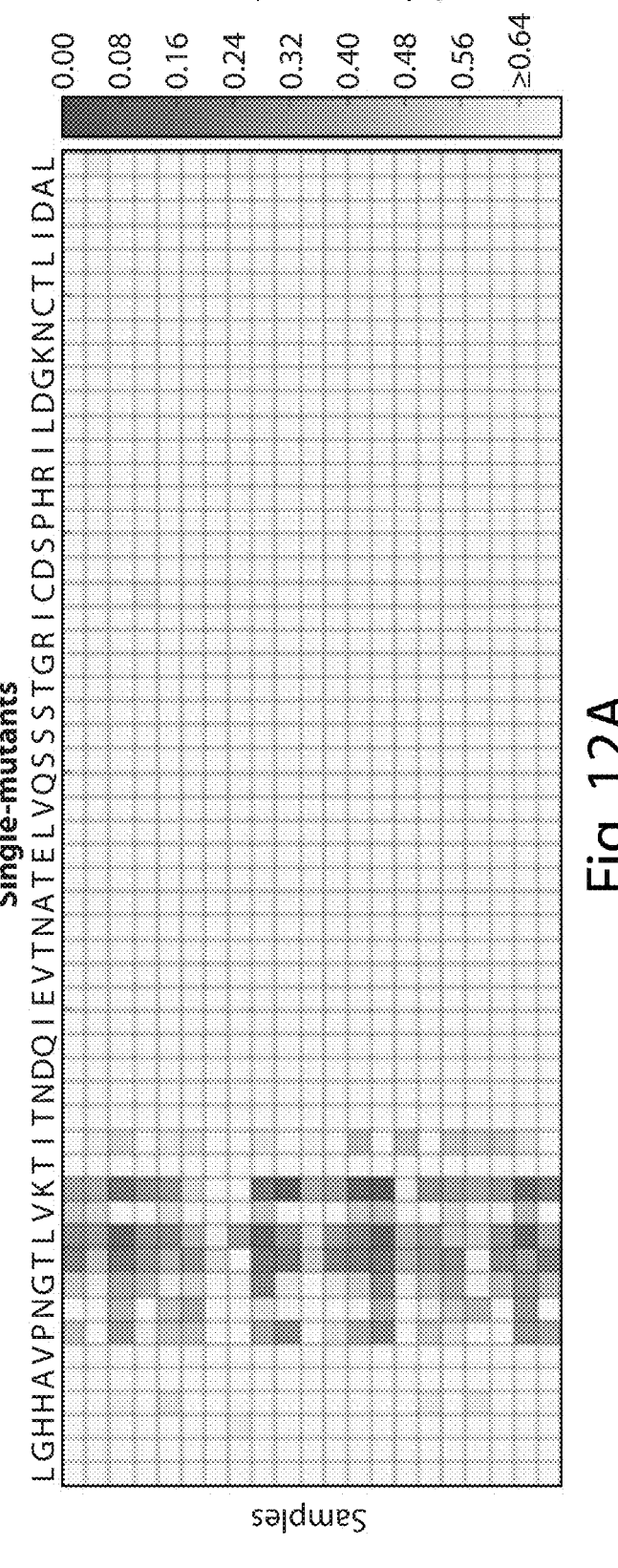
FIGS. 12A-12C Influenza A: hemagglutinin (UniProt ID: H8PET1, positions 1-56) Scanning mutagenesis identification of linear B cell epitopes in an immunogenic peptide from human viral proteins. Each row is a sample. Each column denotes the first mutated position for (FIG. 12A) single- (SEQ ID NO: 34), (FIG. 12B) double- (SEQ ID NO: 34), and (FIG. 12C) triple-alanine (SEQ ID NO: 34) triple-alanine mutant peptides. The intensity of each cell indicates the enrichment of the mutant peptide relative to the wild-type. For double-mutants, the last position is blank. The same is true for the last two positions for triple-mutants. Data shown are the mean of two replicates.
Figure 12B:
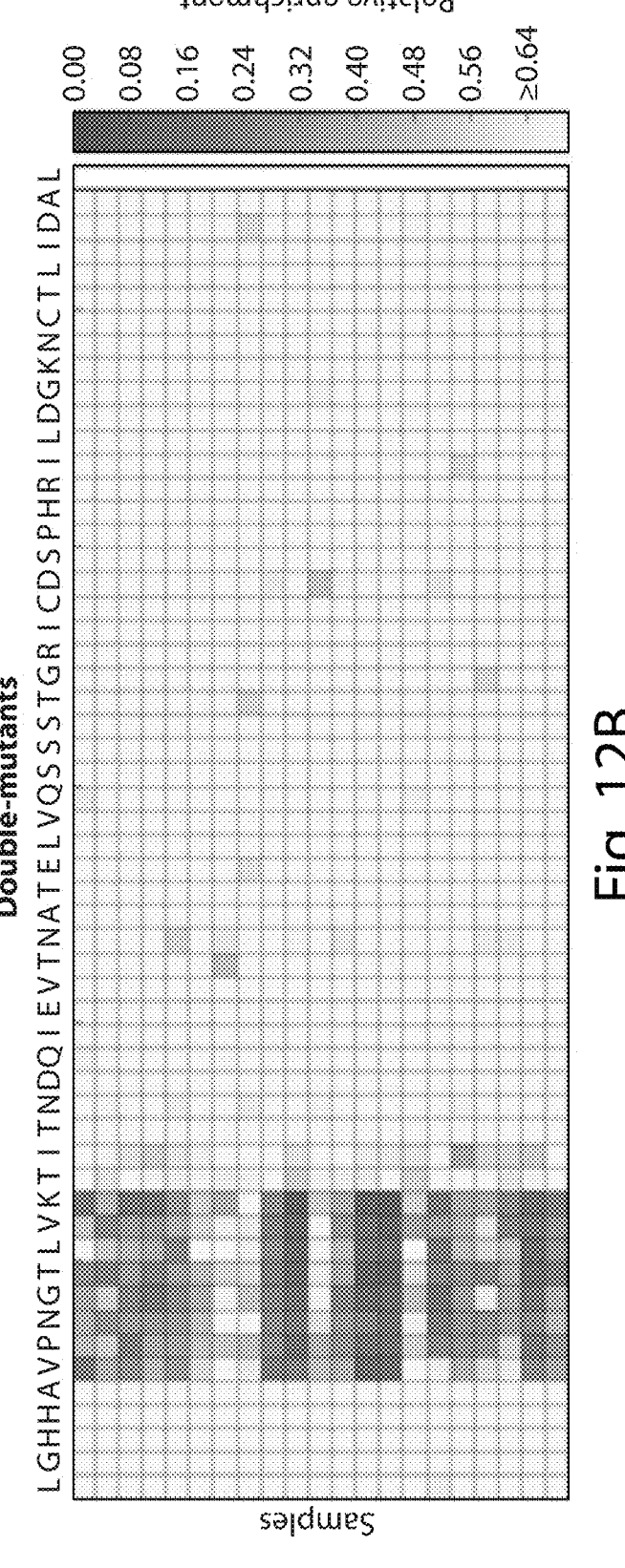
Figure 12C:
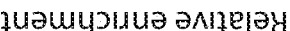
Figure 12C:
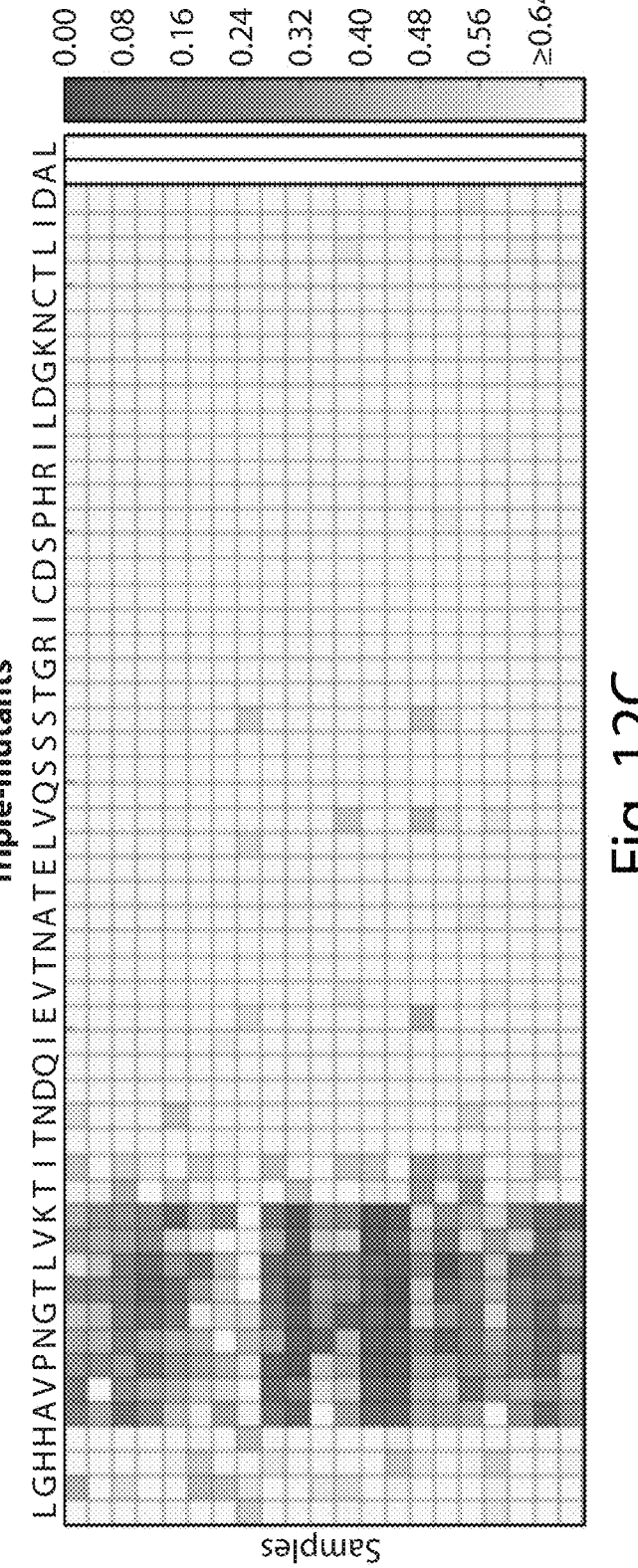
Figure 13A:
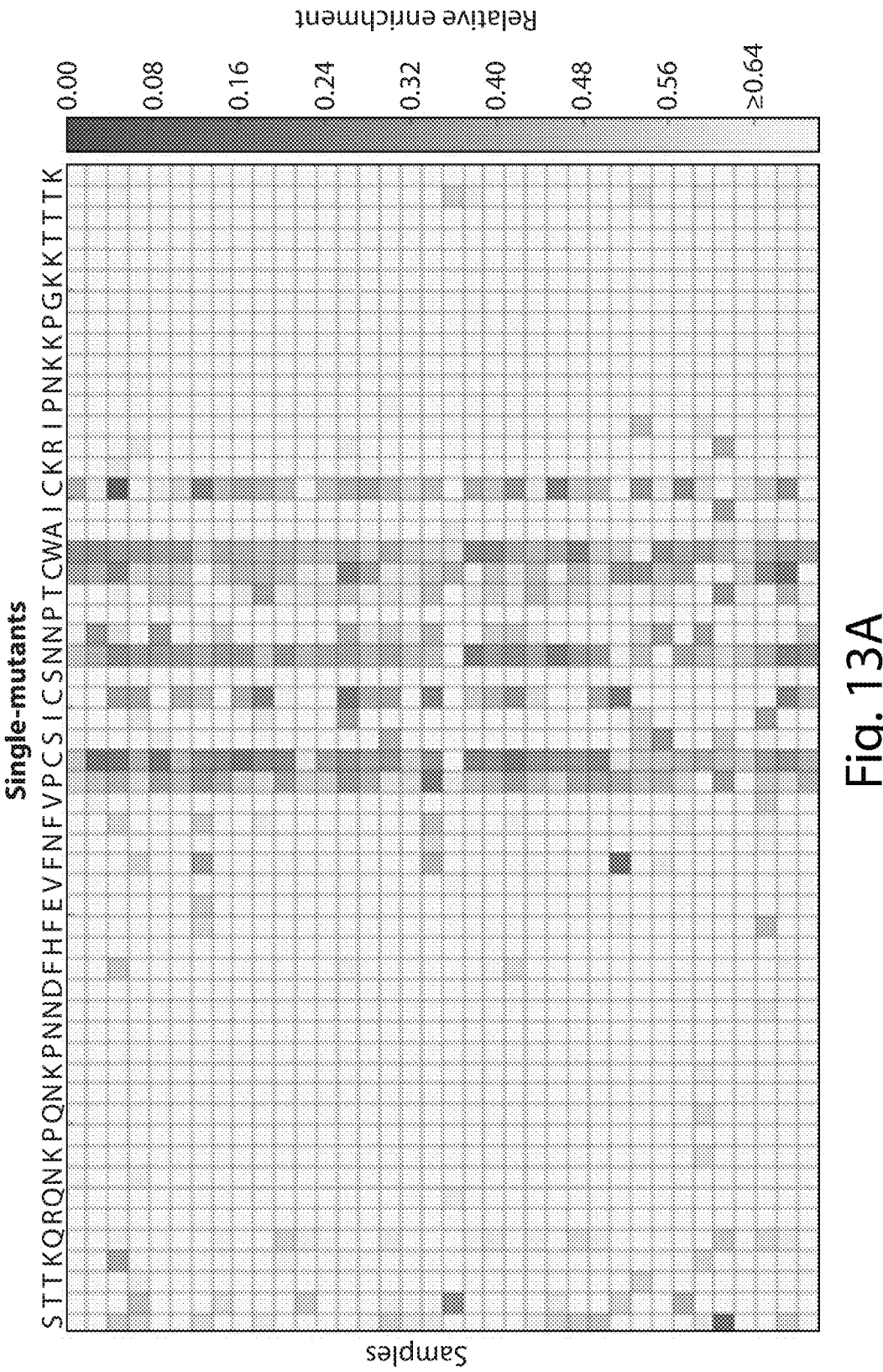
FIGS. 13A-13C Respiratory syncytial virus: attachment G glycoprotein (UniProt ID: P03276, positions 337-392) Scanning mutagenesis identification of linear B cell epitopes in an immunogenic peptide from human viral proteins. Each row is a sample. Each column denotes the first mutated position for (FIG. 13A) single- (SEQ ID NO: 35), (FIG. 13B) double- (SEQ ID NO: 35), and (FIG. 13C) triple-alanine (SEQ ID NO: 35) mutant peptides. The intensity of each cell indicates the enrichment of the mutant peptide relative to the wild-type. For double-mutants, the last position is blank. The same is true for the last two positions for triple-mutants. Data shown are the mean of two replicates.
Figure 13B:
Figure 13C:
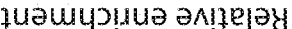
Figure 14A:
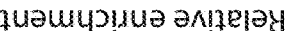
FIGS. 14A-14C Enterovirus B: genome polyprotein (UniProt ID: Q66474, positions 561-616) Scanning mutagenesis identification of linear B cell epitopes in an immunogenic peptide from human viral proteins. Each row is a sample. Each column denotes the first mutated position for (FIG. 14A) single- (SEQ ID NO: 36), (FIG. 14B) double- (SEQ ID NO: 36), and (FIG. 14C) triple-alanine (SEQ ID NO: 36) mutant peptides. The intensity of each cell indicates the enrichment of the mutant peptide relative to the wild-type. For double-mutants, the last position is blank. The same is true for the last two positions for triple-mutants. Data shown are the mean of two replicates.
Figure 14B:
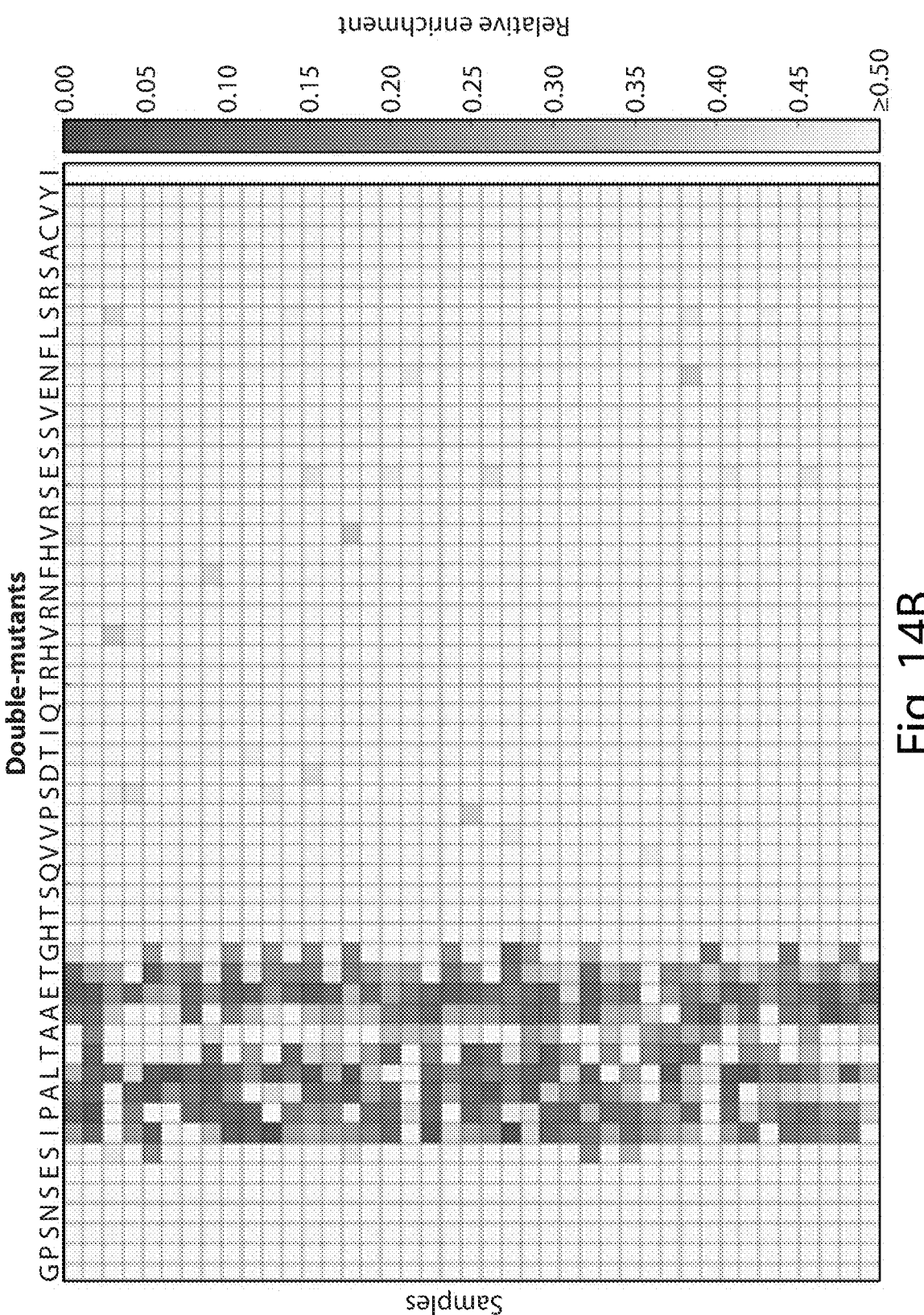
Figure 14C:
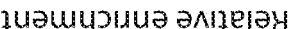

After analyzing responses on the whole virus level, the inventors focused their attention on the specific peptides targeted by these antibodies. They detected antibodies to a total of 3,041 unique peptides in at least 2 samples, and 5,314 in at least 1 sample. Because of the presence of many related peptides in the library and the Immune Epitope Database (IEDB), for the following analysis the inventors consider a peptide "unique" only if it does not contain a continuous 7-residue subsequence (the estimated size of a linear B cell epitope) in common with any other peptide in the database. Analyzed as such, the VirScan database nearly doubles the 1,715 unique human B cell epitopes from human viruses in the IEDB (22). The epitopes identified in our unbiased analysis demonstrate a significant overlap with those contained in the IEDB ($p < 10^{-30}$, FIG. 4B). The amount of overlap is even greater for epitopes from viruses that commonly cause infection (FIG. 4D). It may have been possible to detect even more immunogenic peptides in common with the IEDB if more samples from individuals infected with rare viruses were tested. The inventors next analyzed the amino acid composition of recurrently enriched peptides. Enriched peptides tend to have more proline and charged amino acids and fewer hydrophobic amino acids, which is consistent with a previous analysis of B cell epitopes in the IEDB (FIGS. 11A-11B) (23). This trend likely reflects enrichment for amino acids that are surface exposed or can form stronger interactions with antibodies.

B Cell Responses Target Highly Similar Viral Epitopes Across Individuals

Figures 6A, 6B:
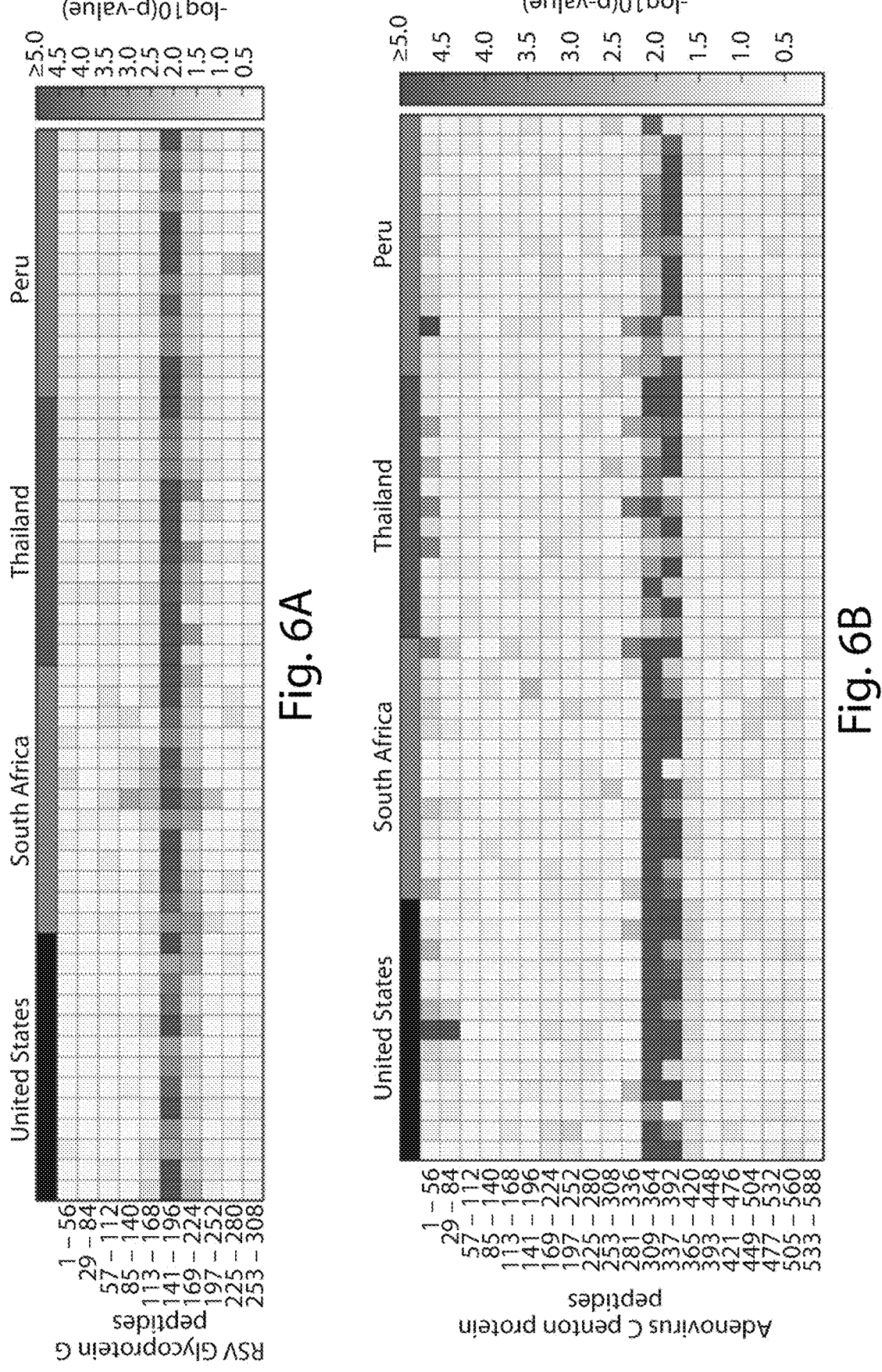
FIGS. 6A-6C show data indicating that the human anti-virome response recognizes a similar spectrum of peptides among infected individuals. In the heatmap charts, each row is a peptide tiling across the entire indicated protein and each column is a sample. The bar above each column, labeled at the top of the figure, marks the country of origin for that sample. The samples shown are a subset of individuals with antibodies to at least one peptide from the proteins indicated. The intensity of each cell corresponds to the $-\log_{10}$(p-value) measure of significance of enrichment for a peptide in a sample (greater values indicates stronger antibody response). Data are shown for (FIG. 6A) Human respiratory syncytial virus Attachment Glycoprotein G (G), (FIG. 6B) Human adenovirus C penton protein (L2), and (FIG. 6C) Epstein-Barr virus nuclear antigen 1 (EBNA1). Data shown are the mean of two replicates.

The inventors compared the profile of peptides recognized by the antibody response in different individuals and found that for a given protein, each sample generally only had strong responses against one to three immunodominant peptides (FIG. 6). Surprisingly, it was found that the vast majority of seropositive samples for a given virus recognized the same immunodominant peptides, indicating that the antiviral B cell response is highly stereotyped across individuals. For example, in glycoprotein G from respiratory syncytial virus, there is only a single immunodominant peptide comprising positions 141-196 that is targeted by all samples with detectable antibodies to the protein, regardless of the country of origin (FIG. 6A).

Figure 6C:
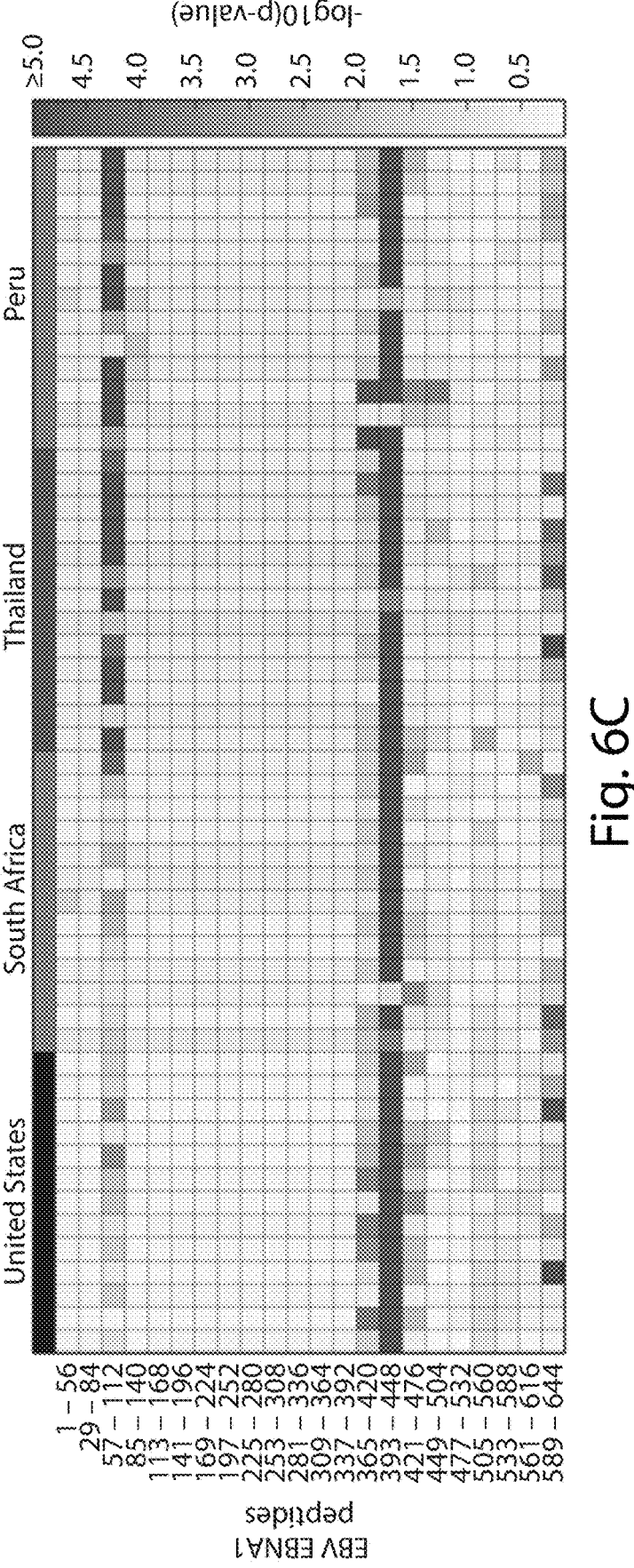
Figures 7A, 7B:
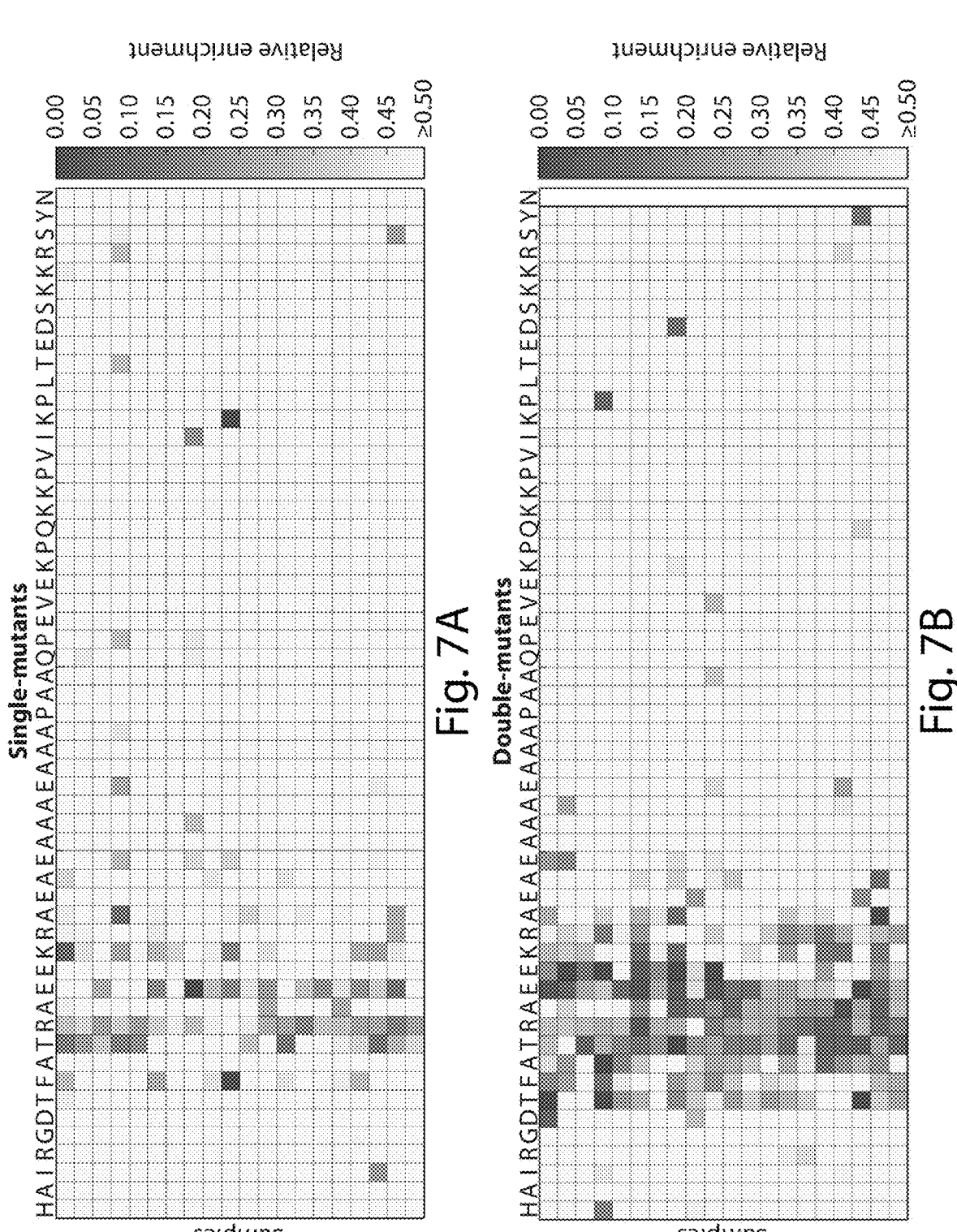
FIGS. 7A-7C Recognition of common epitopes within an immunogenic peptide from human adenovirus C penton protein (L2) across individuals. Each row is a sample. Each column denotes the first mutated position for the (FIG. 7A) single-(SEQ ID NO: 33), (FIG. 7B) double-(SEQ ID NO: 33), and (FIG. 7C) triple-alanine (SEQ ID NO: 33) mutant peptide scanning through. The intensity of each cell indicates the enrichment of the mutant peptide relative to the wild-type. For double-mutants, the last position is blank. The same is true for the last two positions for triple-mutants. Data shown are the mean of two replicates.
Figure 7C:
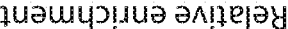
Figure 7C:
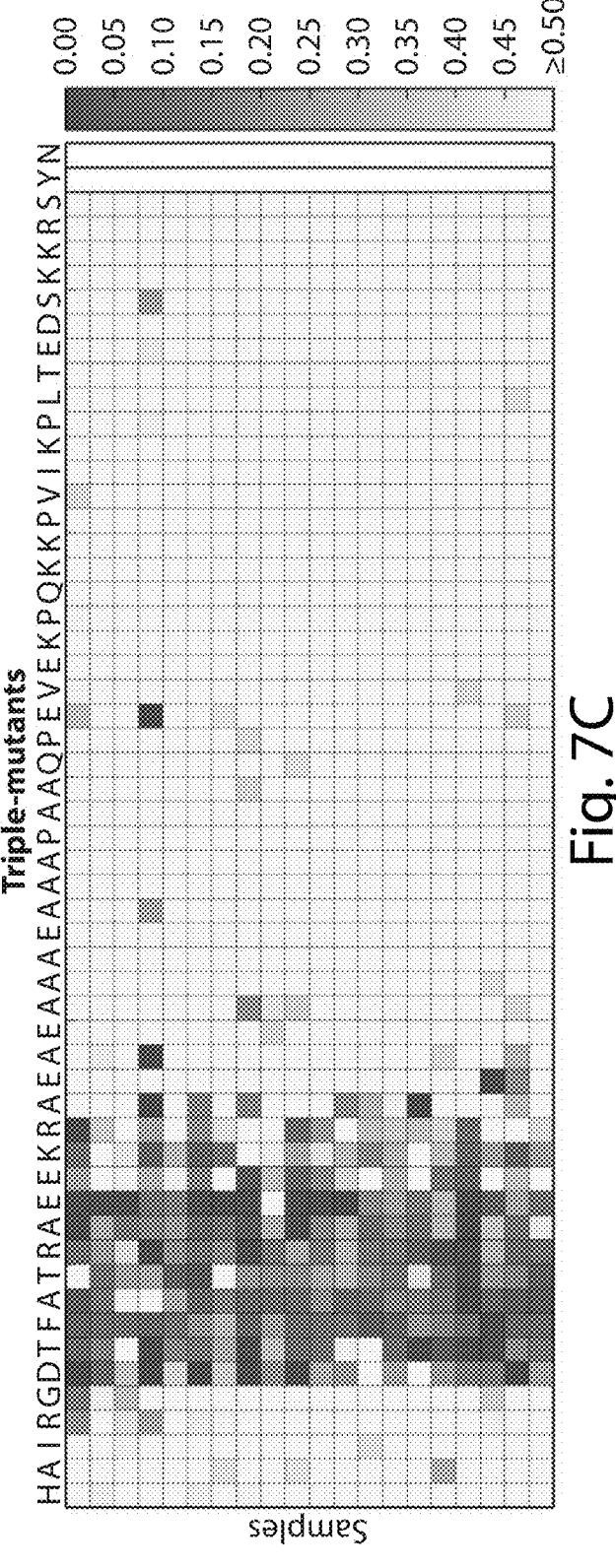

For other antigens, the inventors observed inter-population serological differences. For example, two overlapping peptides from position 309-364 and 337-392 of the penton base protein from Adenovirus C frequently elicited antibody responses (FIG. 6B). However, donors from the United States and South Africa had much stronger responses to peptide 309-364 ($p<10^{-6}$) relative to donors from Thailand and Peru. The inventors observed that for the EBNA1 protein from Epstein Barr virus, donors from all four countries frequently had strong responses to peptide 393-448 and occasionally to peptide 589-644. However, donors from Thailand and Peru had much stronger responses to peptide 57-112 ($p<10-6$) (FIG. 6C). These differences may reflect variation in the strains endemic in each region. In addition, polymorphism of MHC class II alleles, immunoglobulin genes and other modifiers that shape immune responses in each population likely play a role in defining the relative immunodominance of antigenic peptides.

Figure 15A:
FIGS. 15A-15C Enterovirus B: genome polyprotein (UniProt ID: Q6W9F9, positions 1429-1484) Scanning mutagenesis identification of linear B cell epitopes in an immunogenic peptide from human viral proteins. Each row is a sample. Each column denotes the first mutated position for (FIG. 15A) single- (SEQ ID NO: 37), (FIG. 15B) double- (SEQ ID NO: 37), and (FIG. 15C) triple-alanine (SEQ ID NO: 37) mutant peptides. The intensity of each cell indicates the enrichment of the mutant peptide relative to the wild-type. For double-mutants, the last position is blank. The same is true for the last two positions for triple-mutants. Data shown are the mean of two replicates.
Figure 15B:
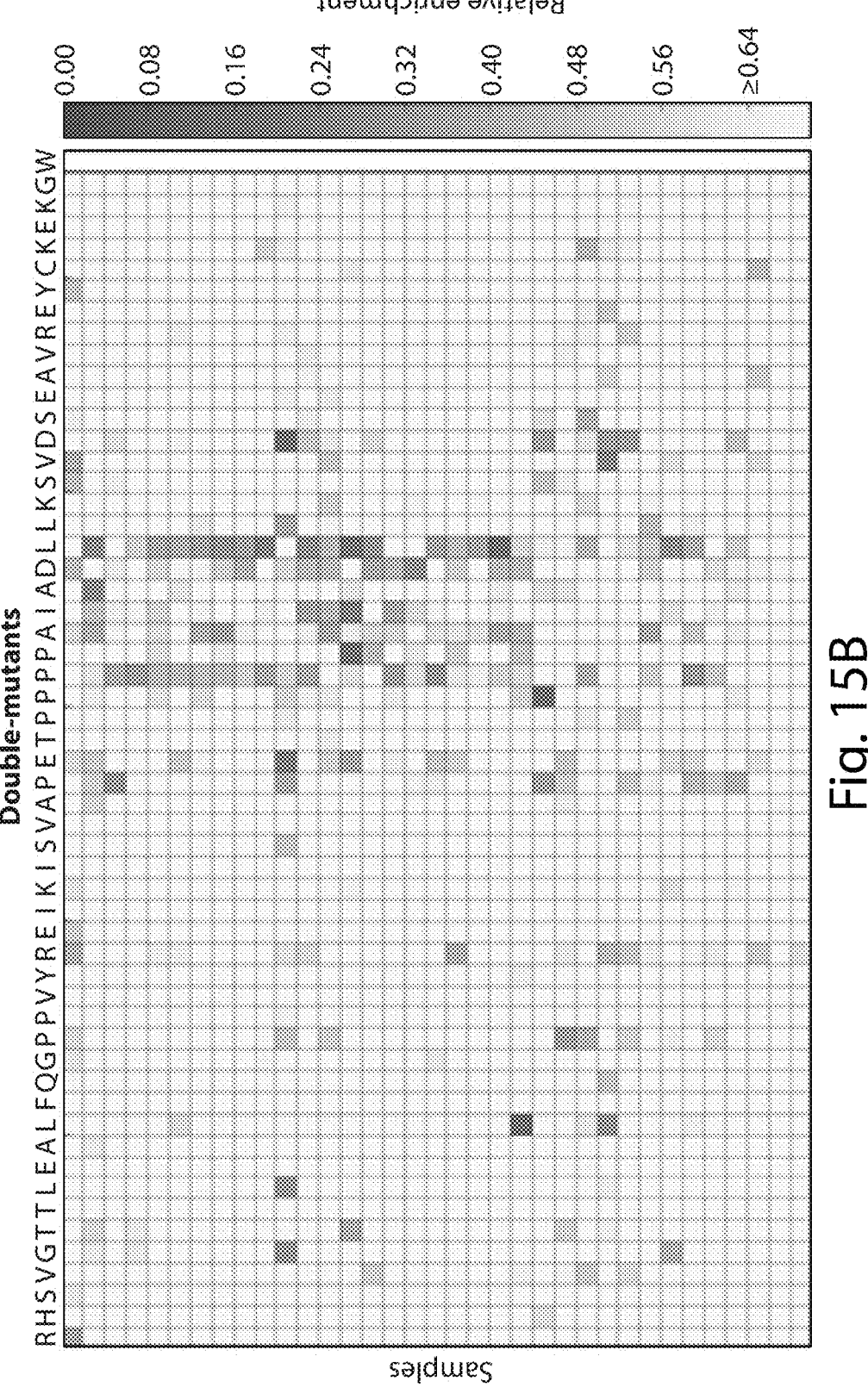
Figure 15C:
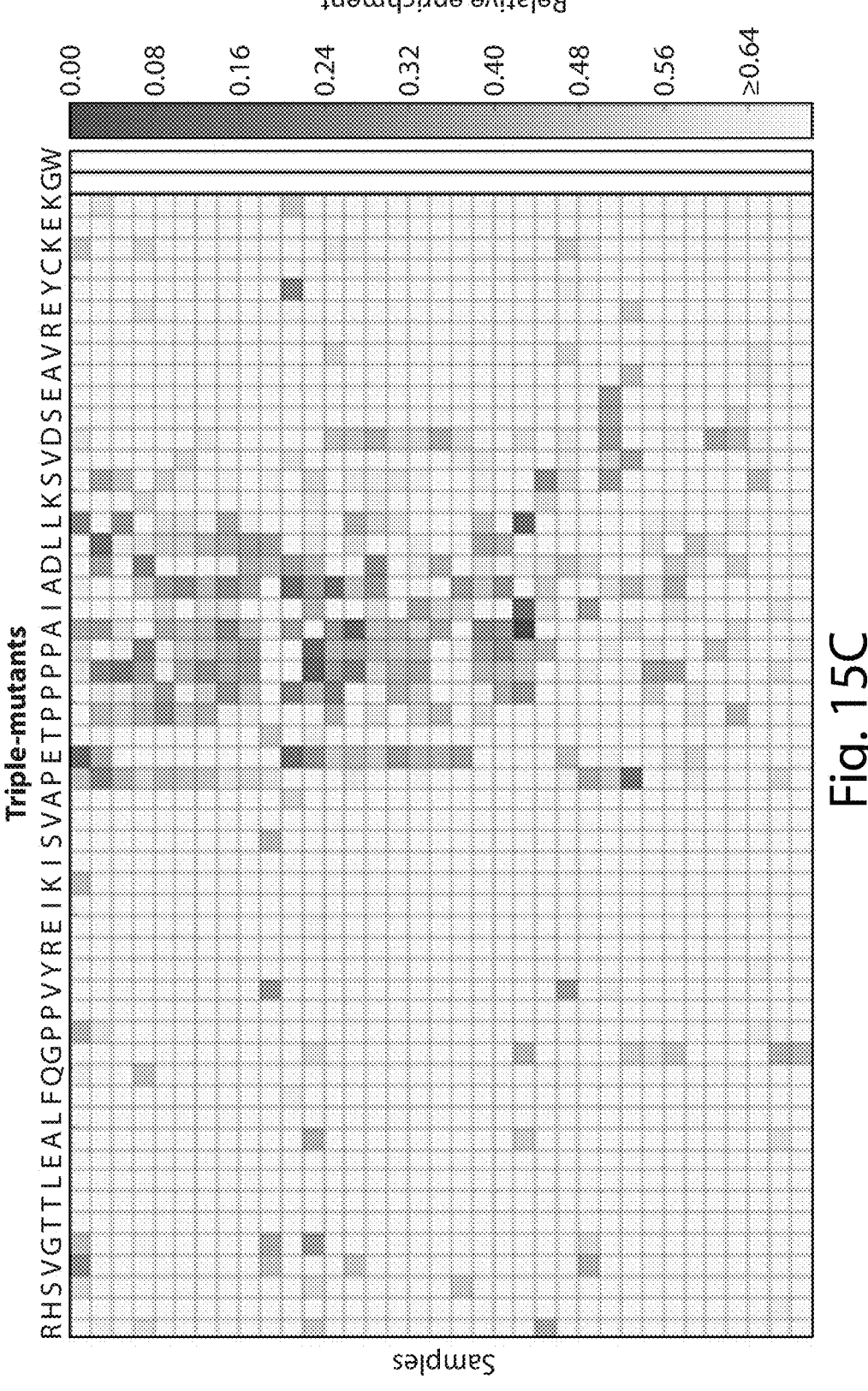
Figure 16A:
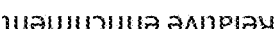
FIGS. 16A-16C Rhinovirus A: genome polyprotein (UniProt ID: Q82122, positions 561-616) Scanning mutagenesis identification of linear B cell epitopes in an immunogenic peptide from human viral proteins. Each row is a sample. Each column denotes the first mutated position for (FIG. 16A) single- (SEQ ID NO: 38), (FIG. 16B) double- (SEQ ID NO: 38), and (FIG. 16C) triple-alanine (SEQ ID NO: 38) mutant peptides. The intensity of each cell indicates the enrichment of the mutant peptide relative to the wild-type. For double-mutants, the last position is blank. The same is true for the last two positions for triple-mutants. Data shown are the mean of two replicates.
Figure 16B:
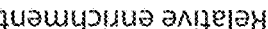
Figure 16C:
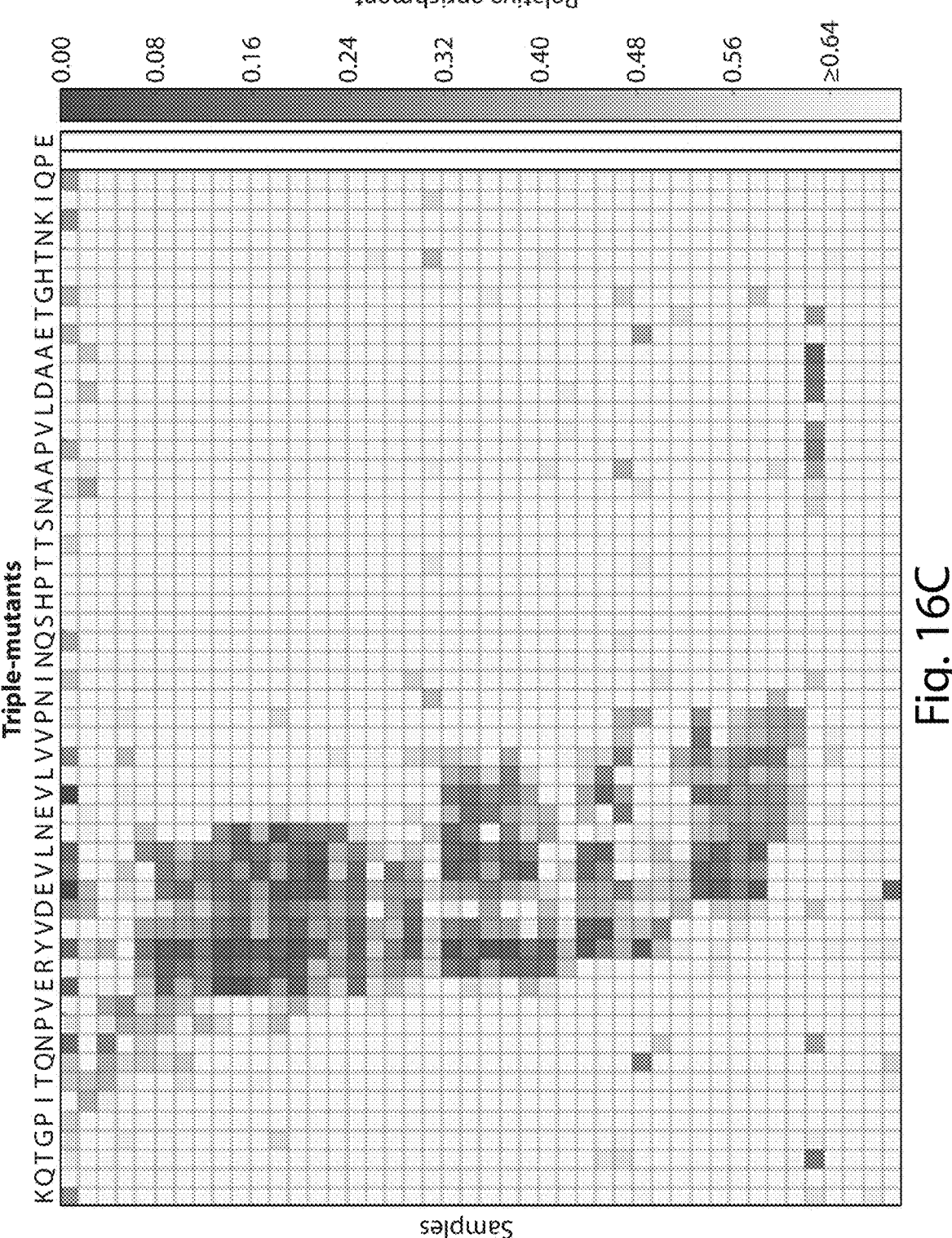
Figure 17A:
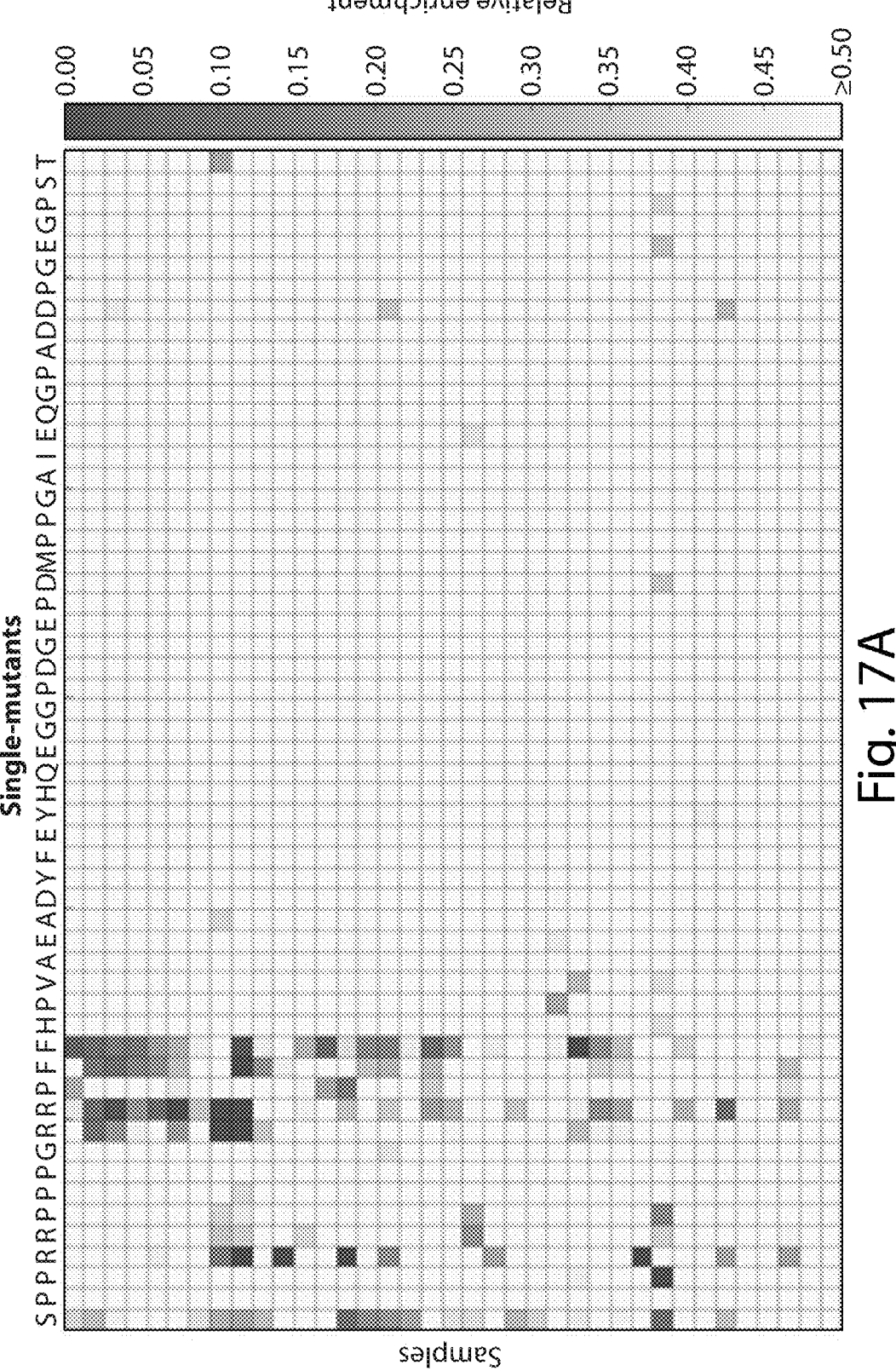
FIGS. 17A-17C Epstein-Barr virus: nuclear antigen 1 (UniProt ID: Q1HVF7, positions 393-448) Scanning mutagenesis identification of linear B cell epitopes in an immunogenic peptide from human viral proteins. Each row is a sample. Each column denotes the first mutated position for (FIG. 17A) single- (SEQ ID NO: 39), (FIG. 17B) double- (SEQ ID NO: 39), and (FIG. 17C) triple-alanine (SEQ ID NO: 39) mutant peptides. The intensity of each cell indicates the enrichment of the mutant peptide relative to the wild-type. For double-mutants, the last position is blank. The same is true for the last two positions for triple-mutants. Data shown are the mean of two replicates.
Figure 17B:
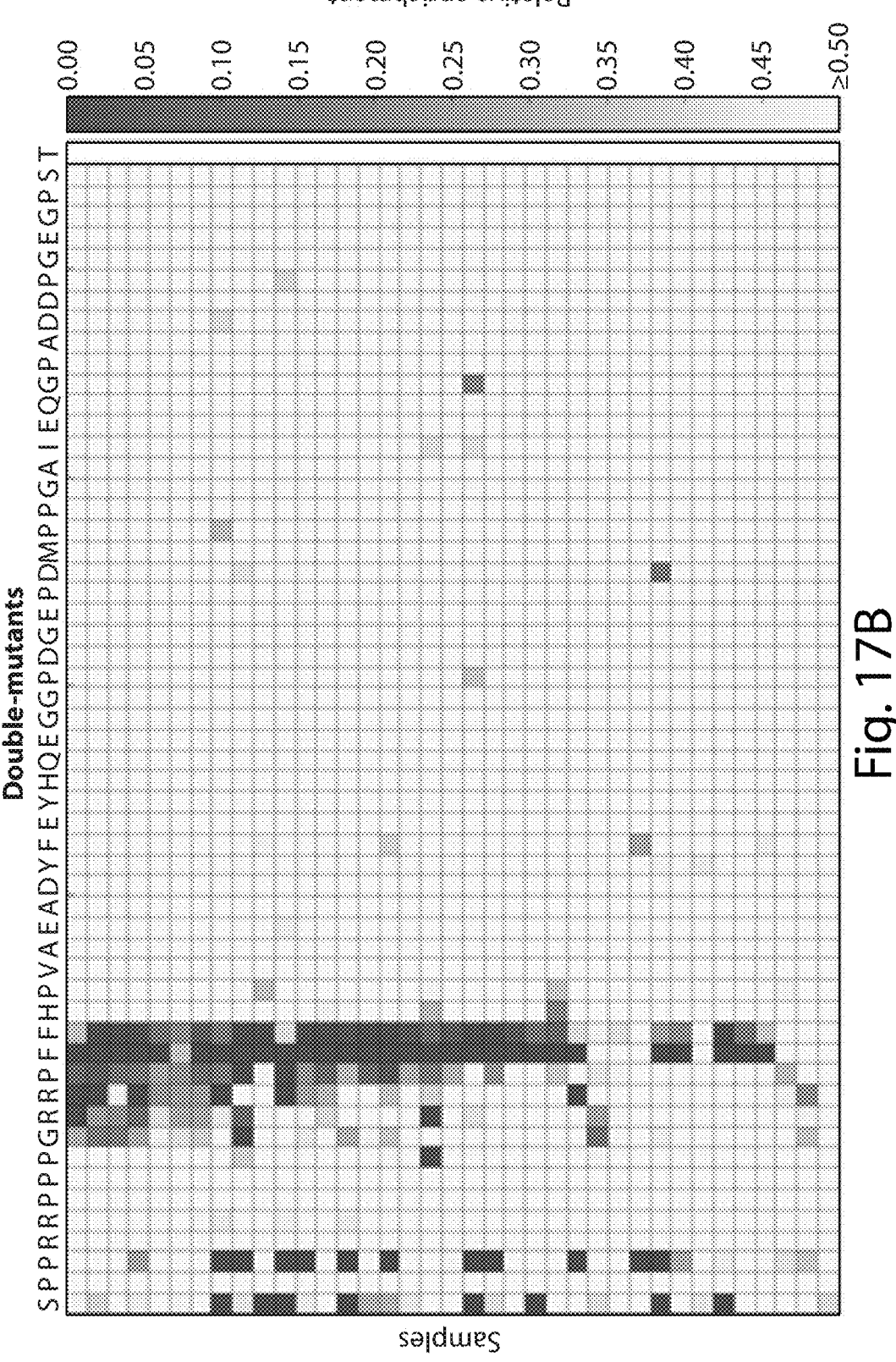
Figure 17C:
Figure 18A:
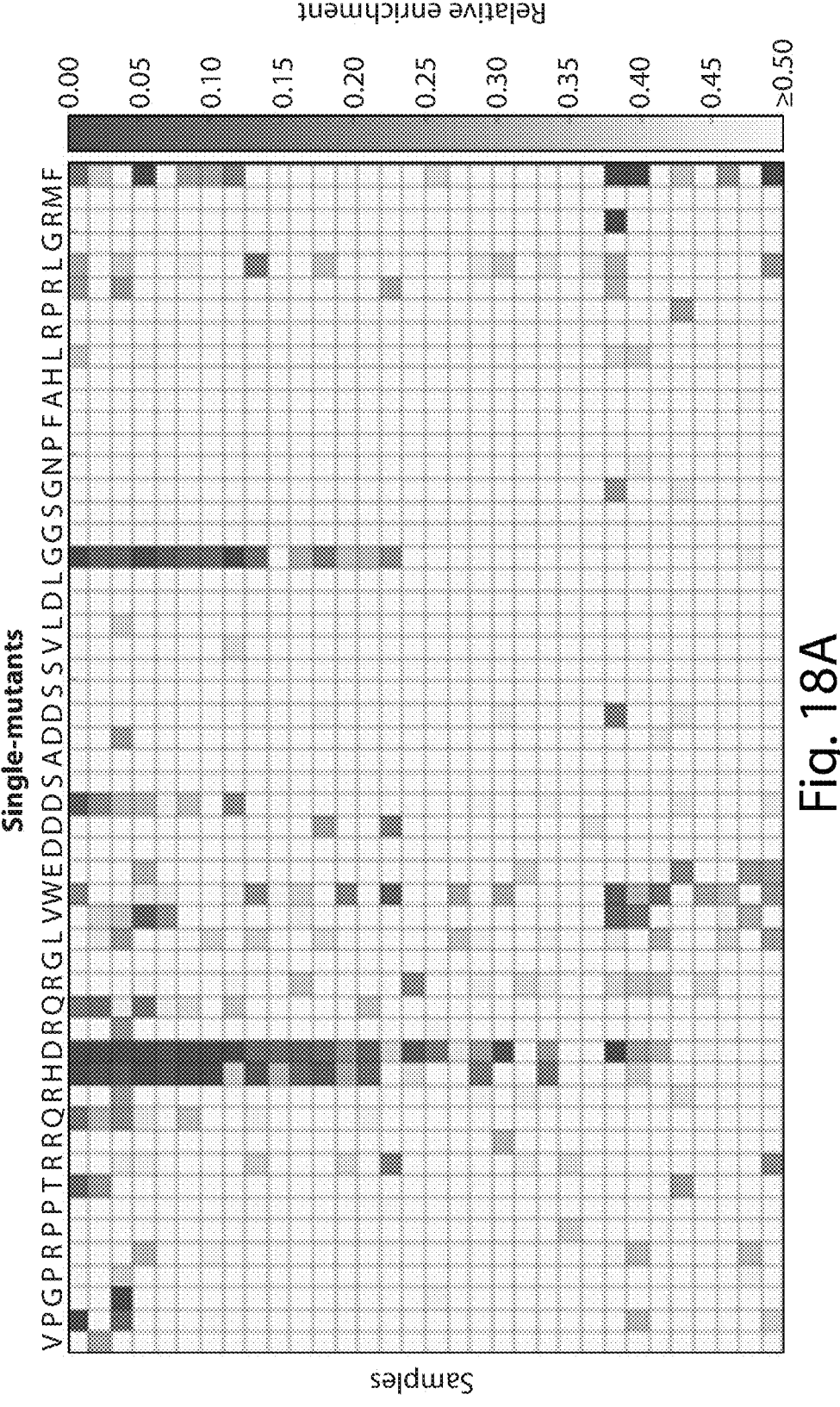
FIGS. 18A-18C Adenovirus C: precapsid vertex protein (UniProt ID: P03279, positions 533-585) Scanning mutagenesis identification of linear B cell epitopes in an immunogenic peptide from human viral proteins. Each row is a sample. Each column denotes the first mutated position for (FIG. 18A) single- (SEQ ID NO: 40), (FIG. 18B) double- (SEQ ID NO: 40), and (FIG. 18C) triple-alanine (SEQ ID NO: 40) mutant peptides. The intensity of each cell indicates the enrichment of the mutant peptide relative to the wild-type. For double-mutants, the last position is blank. The same is true for the last two positions for triple-mutants. Data shown are the mean of two replicates.
Figure 18B:
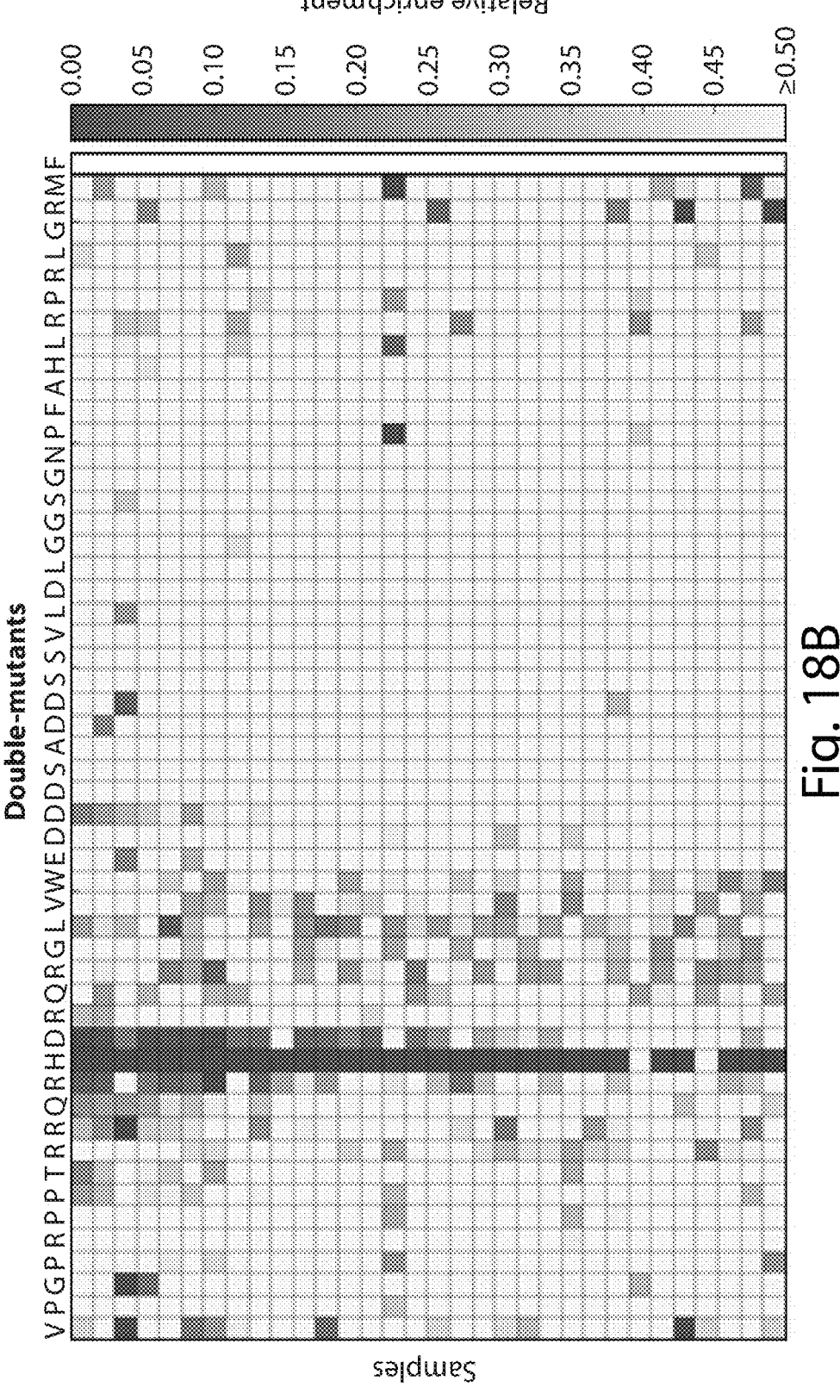
Figure 18C:
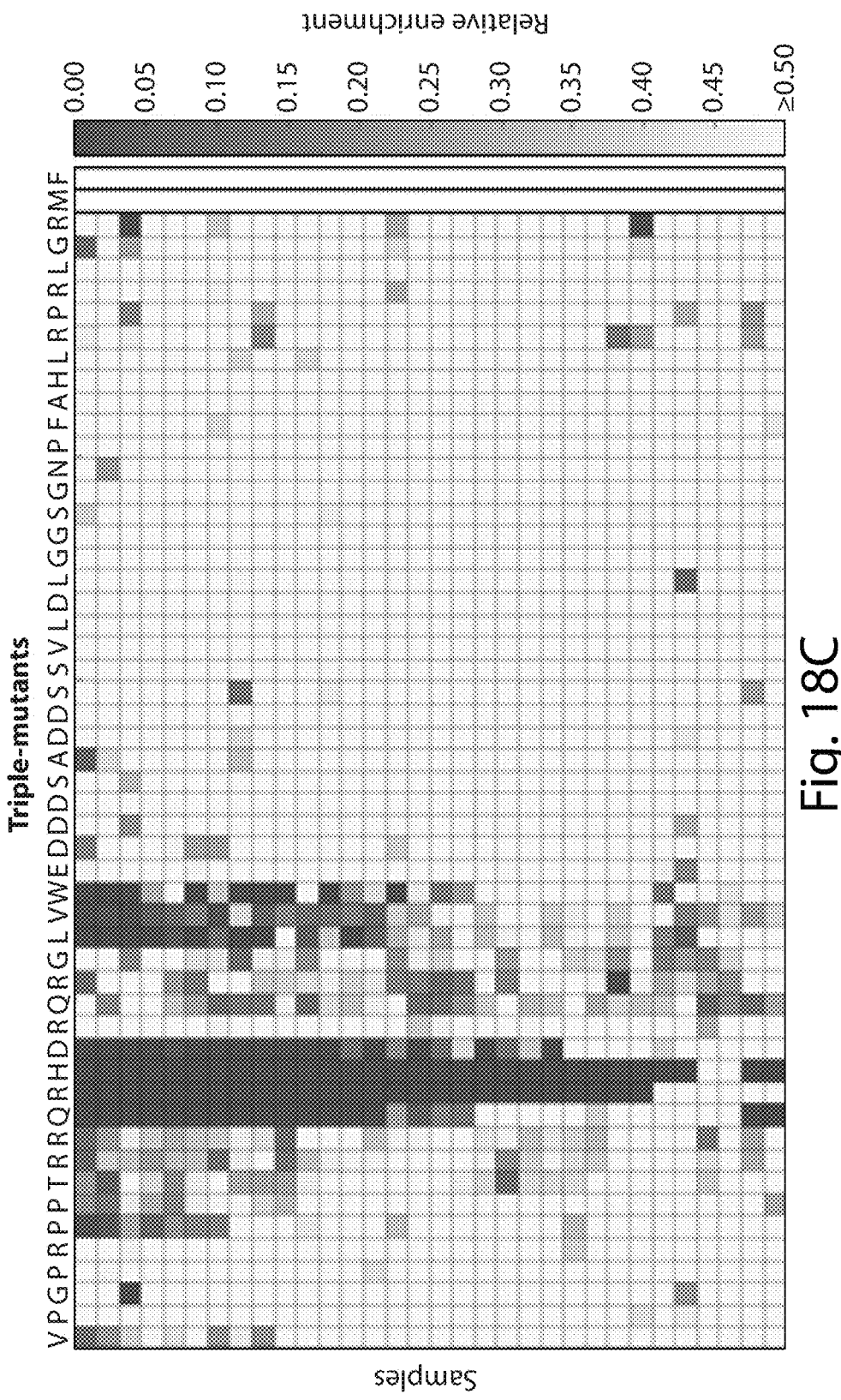

To determine whether the humoral responses that target an immunodominant peptide are actually targeting precisely the same epitope, the inventors constructed single-, double-, and triple-alanine scanning mutagenesis libraries for 8 commonly recognized peptides. These were introduced into the same T7 bacteriophage display vector and subjected to the same immunoprecipitation and sequencing protocol using samples from the United States. Mutants that disrupt the epitope diminish antibody binding affinity and thus peptide enrichment. It was found that for all 8 peptides tested, there was a single, largely contiguous subsequence in which mutations disrupted binding for the majority of samples. As expected, the triple-mutants abolished antibody binding to a greater extent, and the enrichment patterns were similar among single-, double- and triple-mutants of the same peptide (FIG. 7, FIGS. 12-18). For 4 of the 8 peptides, a 9 to 15 amino acid region was critical for antibody recognition in >90% of samples (FIG. 7, FIGS. 12-14). One other peptide had a region of similar size that was critical in about half of the samples (FIG. 15). In another peptide, a single region was important for antibody recognition in the majority of the samples, but the extents of the critical region varied slightly for different samples and occasionally there are donors that recognize a completely separate epitope (FIG. 16). The remaining two peptides contained a single triple mutant that abolished binding in the majority of samples, but the critical region also extended further to different extents depending on the sample (FIGS. 17-18). Surprisingly, in one of these peptides, in addition to the main region surrounding positions 13-14 that is critical for binding, a single G36A mutation disrupted binding in almost half of the samples whereas none of the double- or triple-alanine mutants that also included the adjacent positions (L35, G37) affected binding (FIG. 18). It is possible that G36 plays a role in helping the peptide adopt an antigenic conformation and multiple-mutants containing the adjacent Leu or Gly residues rescue this ability. The inventors occasionally saw other examples of mutations that resulted in patterns of disrupted binding with no simple explanation, illustrating the complexity of antibody-antigen interaction.

Described herein is "VirScan", a technology for identifying viral exposure and B cell epitopes across the entire known human virome in a single, multiplex reaction using less than a drop of blood. VirScan uses DNA microarray synthesis and bacteriophage display to create a uniform, synthetic representation of peptide epitopes comprising the human virome. Immunoprecipitation and high-throughput DNA sequencing reveals the peptides recognized by antibodies in the sample. VirScan is easily automated in 96-well format to enable high throughput sample processing. Barcoding of samples during PCR enables pooled analysis which can dramatically reduce the per-sample cost. The VirScan approach has several advantages for studying the effect of viruses on the host immune system. By detecting antibody responses, it can identify infectious agents that have been cleared after an effective host response. Current serological methods of antiviral antibody detection typically employ the selection of a single optimized antigen in order to achieve high accuracy. In contrast, VirScan's unique approach does not require such optimization in order to obtain similar performance. VirScan achieves high sensitivity by assaying each virus's complete proteome to detect any antibodies directed to epitopes that can be captured in a 56-residue fragment and high specificity by computationally eliminating cross-reactive antibodies. This unbiased approach identifies exposure to less well-studied viruses for which optimal serological antigens are not known and can be rapidly extended to include new viruses as they are discovered (24).

While sensitive and selective, VirScan also has a few limitations. First, it cannot detect epitopes that require post-translational modifications. Secondly, it cannot detect epitopes that involve discontinuous sequences on protein fragments greater than 56 residues. In principle, the latter can be overcome by using longer peptides or by using alternative protein display technologies such as Parallel Analysis of Translated ORFs (PLATO) (25). Third, VirScan is likely to be less specific compared with certain nucleic acid tests that discern highly related virus strains. However, VirScan demonstrates excellent serological discrimination among similar virus species, such as HSV1 and HSV2 and can even distinguish the genotype of HCV 72% of the time. The inventors envision VirScan will become an important tool for first-pass unbiased serologic screening applications. Individual viruses or viral proteins uncovered in this way can subsequently be analyzed in further detail using more focused assays, as demonstrated for a panel of immunodominant epitopes.

The inventors have demonstrated that VirScan is a sensitive and specific assay for detecting exposure to viruses across the human virome. Because it can be performed in high-throughput and requires minimal sample and cost, VirScan enables rapid and cost-effective screening of large numbers of samples to identify population-level differences in virus exposure across the human virome. In this work, the inventors analyzed over 106 million antibody-viral peptide interactions, in the first comprehensive study of pan-virus serology in a large, diverse population. In doing so we 87 different viral species were detected in 2 or more individuals. This is likely to be an underestimate of the history of viral infection as temporally distant infections may have significantly lower levels of circulating antibodies that are more difficult to detect. In addition, within a species an individual can be infected by multiple distinct strains of that viral species. The inventors identified known and novel differences in virus exposure between groups differing in age, HIV status, and geographic location across four different continents. The results described herein are largely consistent with previous studies, validating the effectiveness of VirScan. For example, cytomegalovirus antibodies were found in significantly higher frequencies in Peru, Thailand, and South Africa whereas Kaposi's sarcoma-associated herpesvirus and HSV1 antibodies were detected more frequently in Peru and South Africa, but not Thailand (15, 26-30). The inventors also uncovered previously undocumented serological differences, such as an increased rate of antibodies against Adenovirus B and respiratory syncytial virus in HIV positive individuals compared to HIV negative individuals. These differences can provide insight into how HIV co-infection alters the balance between host immunity and resident viruses, as well as help to identify pathogens that can increase susceptibility to HIV and other heterologous infections. HIV infection can reduce the immune system's ability to control reactivation of normally dormant resident viruses or to prevent opportunistic infections from taking hold and triggering a strong adaptive immune response. Beyond the epidemiological applications demonstrated here, VirScan can also be applied to identify viral exposures that correlate with disease or other phenotypes in virome-wide association studies.

These result identify a large number of novel B cell epitopes, cumulatively nearly doubling the number of all previously identified viral epitopes. Knowledge of these epitopes and the extent of their recognition can have important implications beyond the identification of potential neutralizing antibody targets or improving B cell epitope prediction algorithms. For example, these epitopes can be used to improve vaccine design by piggybacking on existing immune responses. Fusing a previously detected and globally recognized B cell epitope to an antigen can increase a vaccine's efficacy among a broad population by improving antigen presentation and aiding affinity maturation. B cells recognizing the epitope can act as antigen presenting cells to re-present epitopes on MHC class I and II (31). Antibodies secreted by these B cells can also participate in immune complexes with the antigen, which are critical for follicular dendritic cells to prime class switching and affinity maturation of B cells recognizing other epitopes on the same antigen (32). The inventors have utilized these data to identify globally immunodominant and commonly recognized "public" epitopes that can be used for this purpose. For most species of viruses, a single peptide is recognized in over 70% to 97% of samples positive for that species (Table 3).

TABLE 3

Certain peptides are commonly targeted by the antibody response. The inventors determined the peptide from each species of virus that was most frequently targeted in donors that were exposed to that virus. In each row, the frequency is the percentage of samples positive for the species of virus that had antibodies targeting the peptide sequence shown. The parent protein of the peptide is also listed.

| Species | Protein | Peptide | SEQ ID NO: | % |
|---|---|---|---|---|
| Rhinovirus B | Genome polyprotein | QTDALTE GLSDELE EVIVEKT KQTLASV SSGPKHT QSVPALT ANETGAT LPTRPSD | 2 | 97.2% |
| Human herpesvirus 5 | Envelope glycoprotein M | TASGEEV AVLSHHD SLESRRL REEEDDD DDEDFED A | 3 | 92.7% |
| Enterovirus B | Genome polyprotein | IEQKQLL QGDVEEA VNRAVAR VADTLPT GPRNSES IPALTAA ETGHTSQ VVPGDTM | 4 | 94.1% |

TABLE 3-continued

Certain peptides are commonly targeted by the antibody response. The inventors determined the peptide from each species of virus that was most frequently targeted in donors that were exposed to that virus. In each row, the frequency is the percentage of samples positive for the species of virus that had antibodies targeting the peptide sequence shown. The parent protein of the peptide is also listed.

| Species | Protein | Peptide | SEQ ID NO: | % |
|---|---|---|---|---|
| Human herpesvirus 1 | Envelope glycoprotein D | RRHTQKA PKRIRLP HIREDDQ PSSHQPL FY | 5 | 88.9% |
| Human herpesvirus 4 | Epstein-Barr nuclear antigen 1 | SPPRRPP PGRRPFF HPVAEAD YFEYHQE GGPDGEP DMPPGAI EQGPADD PGEGPST | 6 | 86.3% |
| Human respiratory syncytial virus | Attachment glycoprotein | NKPSTKP RPKNPPK KPKDDYH FEVFNFV PCSICGN NQLCKSI CKTIPSN KPKKKPT | 7 | 84.9% |
| Human adenovirus C | Pre-histone-like nucleoprotein | MTQGRRG NVYWVRD SVSGLRV PVRTRPP RN | 8 | 80.1% |
| Enterovirus C | Genome polyprotein | QGALTLS LPKQQDS LPDTKAS GPAHSKE VPALTAV ETGATNP LAPSDTV QTRHVVQ | 9 | 85.4% |
| Human herpesvirus 3 | Envelope glycoprotein C | PDPAVAP TSAASRK PDPAVAP TSAASRK PDPAVAP TSAATRK PDPAVAP TSAASRK | 10 | 76.9% |
| Norwalk virus | Non-structural polyprotein | LSSMAIT FKRALGA RPKQPPP REILQRP PRPPTPE LVKKIPP PPPNGED ELWSYS | 11 | 84.6% |

TABLE 3-continued

Certain peptides are commonly targeted by the antibody response. The inventors determined the peptide from each species of virus that was most frequently targeted in donors that were exposed to that virus. In each row, the frequency is the percentage of samples positive for the species of virus that had antibodies targeting the peptide sequence shown. The parent protein of the peptide is also listed.

| Species | Protein | Peptide | SEQ ID NO: | % |
|---|---|---|---|---|
| Human immunodeficiency virus 1 | Envelope glycoprotein gp160 | ERYLKDQ QLLGIWG CSGKLIC TTAVPWN ASWSNKS LEQIWNN MTWMEWD REINNYT | 12 | 75.8% |
| Influenza A virus | Hemagglutinin | LGHHAVP NGTLVKT ITNDQIE VTNATEL VQSSSTG RICDSPH RILDGKN CTLIDAL | 13 | 47.9% |

The inventors identified a set of two peptides that together are recognized by >95% of all screened samples and a set of five peptides that together are recognized in >99% of screened samples. They also found that the B cell response to viral epitopes is highly similar between individuals across many viral proteins. Without wishing to be bound by theory, one possible model for this striking similarity is that these regions possess properties favorable for antigenicity, such as accessibility. Another model is that the same or highly similar B cell receptor sequences that recognize these epitopes are commonly generated. Identical T cell receptor sequences ("public" clonotypes) have been found in multiple individuals and are thought to be the result of biases during the recombination process that favor certain amino acid sequences (33). V(D)J recombination of the immunoglobulin heavy and light chain loci is also heavily biased (34). Highly similar or even identical complementarity determining region 3 (CDR3) sequences have been observed in dengue virus specific antibodies from different individuals (35). Without wishing to be bound by theory, slight differences in the antibody CDR3 sequence may subtly alter antibody-antigen interaction, leading to the slight variations observed in the extent of critical epitope regions. It is possible that, rather than being an exception for dengue specific antibodies, this represents a general phenomenon: inherent biases in V(D)J recombination generate the same or similar antibodies in multiple individuals that recognize highly similar epitopes.

In conclusion, VirScan is a powerful new technology that enables human virome-wide exploration—at the epitope level—of immune responses in large numbers of individuals. The inventors have demonstrated its effectiveness for determining viral exposure and characterizing viral B cell epitopes in high throughput and at high resolution. These studies have revealed intriguing general properties of the human immune system, both at the individual and population scale. VirScan is an important tool in uncovering the effect of host-virome interactions on human health and disease and can easily be expanded to include other human pathogens such as bacteria, fungi and protozoa.

REFERENCES

1. K. M. Wylie, G. M. Weinstock, G. A. Storch, Emerging view of the human virome. *Transl. Res.* 160 (2012), pp. 283-290.
2. B. a Duerkop, L. V Hooper, Resident viruses and their interactions with the immune system. *Nat. Immunol.* 14, 654-9 (2013).
3. E. S. Barton et al., Herpesvirus latency confers symbiotic protection from bacterial infection. *Nature.* 447, 326-329 (2007).
4. E. F. Foxman, A. Iwasaki, Genome-virome interactions: examining the role of common viral infections in complex disease. *Nat. Rev. Microbiol.* 9, 254-264 (2011).
5. M. Lecuit, M. Eloit, The human virome: New tools and concepts. *Trends Microbiol.* 21 (2013), pp. 510-515.
6. I. De Vlaminck et al., XTemporal response of the human virome to immunosuppression and antiviral therapy. *Cell.* 155 (2013), doi:10.1016/j.cell.2013.10.034.
7. E. Hammarlund et al., Duration of antiviral immunity after smallpox vaccination. *Nat. Med.* 9, 1131-1137 (2003).
8. H. B. Larman et al., Autoantigen discovery with a synthetic human peptidome. *Nat. Biotechnol.* 29, 535-541 (2011).
9. The UniProt Consortium, Activities at the Universal Protein Resource (UniProt). *Nucleic Acids Res.* 42, D191-8 (2014).
10. H. B. Larman et al., PhIP-Seq characterization of autoantibodies from patients with multiple sclerosis, type 1 diabetes and rheumatoid arthritis. *J. Autoimmun.* 43, 1-9 (2013).
11. C. Bialecki, H. M. Feder, J. M. Grant-Kels, The six classic childhood exanthems: a review and update. *J. Am. Acad. Dermatol.* 21, 891-903 (1989).
12. J. H. Lee, W. K. Roth, S. Zeuzem, Evaluation and comparison of different hepatitis C virus genotyping and serotyping assays. *J. Hepatol.* 26, 1001-1009 (1997).
13. H. F. L. Wertheim et al., Key role for clumping factor B in *Staphylococcus aureus* nasal colonization of humans. *PLoS Med.* 5, 0104-0112 (2008).
14. R. A. Manz, A. E. Hauser, F. Hiepe, A. Radbruch, Maintenance of serum antibody levels. *Annu. Rev. Immunol.* 23, 367-386 (2005).
15. S. A. S. Staras et al., Seroprevalence of cytomegalovirus infection in the United States, 1988-1994. *Clin. Infect. Dis.* 43, 1143-1151 (2006).
16. M. A. Reynolds, D. Kruszon-Moran, A. Jumaan, D. S. Schmid, G. M. McQuillan, Varicella seroprevalence in the U.S.: data from the National Health and Nutrition Examination Survey, 1999-2004. *Public Health Rep.* 125, 860-9.
17. J. I. Cohen, Epstein-Barr virus infection. *N. Engl. J. Med.* 343, 481-492 (2000).
18. L. Dong et al., A combination of serological assays to detect human antibodies to the avian influenza a H7N9 virus. *PLoS One.* 9 (2014), doi:10.1371/journal.pone.0095612.
19. P. Patel et al., Prevalence and Risk Factors Associated With Herpes Simplex Virus-2 Infection in a Contemporary Cohort of HIV-Infected Persons in the United States. *Sex. Transm. Dis.* 39 (2012), pp. 154-160.

20. C. T. Stover et al., Prevalence of and risk factors for viral infections among human immunodeficiency virus (HIV)-infected and high-risk HIV-uninfected women. *J. Infect. Dis.* 187, 1388-96 (2003).

21. E. A. Engels et al., Risk factors for human herpesvirus 8 infection among adults in the United States and evidence for sexual transmission. *J. Infect. Dis.* 196, 199-207 (2007).

22. R. Vita et al., The Immune Epitope Database 2.0. *Nucleic Acids Res.* 38 (2009), doi:10.1093/nar/gkp1004.

23. H. Singh, H. R. Ansari, G. P. S. Raghava, Improved Method for Linear B-Cell Epitope Prediction Using Antigen's Primary Sequence. *PLoS One.* 8 (2013), doi: 10.1371/journal.pone.0062216.

24. J. L. Mokili, F. Rohwer, B. E. Dutilh, Metagenomics and future perspectives in virus discovery. *Curr. Opin.* Virol. 2 (2012), pp. 63-77.

25. J. Zhu et al., Protein interaction discovery using parallel analysis of translated ORFs (PLATO). *Nat. Biotechnol.* 31, 331-4 (2013).

26. Y. Urwijitaroon, S. Teawpatanataworn, A. Kitjareontarm, Prevalence of cytomegalovirus antibody in Thai-northeastern blood donors. *Southeast Asian J. Trop. Med. Public Health.* 24 Suppl 1, 180-182 (1993).

27. M. J. Cannon, D. S. Schmid, T. B. Hyde, Review of cytomegalovirus seroprevalence and demographic characteristics associated with infection. *Rev. Med. Virol.* 20 (2010), pp. 202-213.

28. S. Mohanna et al., Human herpesvirus-8 in Peruvian blood donors: a population with hyperendemic disease? *Clin. Infect. Dis.* 44, 558-561 (2007).

29. D. Ablashi et al., Seroprevalence of human herpesvirus-8 (HHV-8) in countries of Southeast Asia compared to the USA, the Caribbean and Africa. *Br. J. Cancer.* 81, 893-7 (1999).

30. J. S. Smith, N. J. Robinson, Age-specific prevalence of infection with herpes simplex virus types 2 and 1: a global review. *J. Infect. Dis.* 186 Suppl, S3-S28 (2002).

31. A. Heit et al., CpG-DNA aided cross-priming by cross-presenting B cells. *J. Immunol.* 172, 1501-1507 (2004).

32. Y. Aydar, S. Sukumar, A. K. Szakal, J. G. Tew, The influence of immune complex-bearing follicular dendritic cells on the IgM response, Ig class switching, and production of high affinity IgG. *J. Immunol.* 174, 5358-66 (2005).

33. M. F. Quigley et al., Convergent recombination shapes the clonotypic landscape of the naive T-cell repertoire. *Proc. Natl. Acad. Sci. U.S.A.* 107, 19414-19419 (2010).

34. K. J. L. Jackson, M. J. Kidd, Y. Wang, A. M. Collins, The shape of the lymphocyte receptor repertoire: lessons from the B cell receptor. *Front. Immunol.* 4, 263 (2013).

35. P. Parameswaran et al., Convergent antibody signatures in human dengue. *Cell Host Microbe.* 13, 691-700 (2013).

36. M. Meyer, M. Kircher, Illumina sequencing library preparation for highly multiplexed target capture and sequencing. *Cold Spring Harb. Protoc.* 5 (2010), doi: 10.1101/pdb.prot5448.

37. B. Langmead, C. Trapnell, M. Pop, S. L. Salzberg, Ultrafast and memory-efficient alignment of short DNA sequences to the human genome. *Genome Biol,* 1-10 (2009).

Example 7: Exemplary Materials and Methods

Patient samples: Specimens originating from human donors were collected after informed written consent was obtained and under a protocol approved by the local governing human research protection committee. Secondary use of all samples for the purposes of this work was exempted by the Brigham and Women's Hospital Institutional Review Board (Protocol #: 2013P001337). Samples included donors residing in Thailand (n=48), donors residing in Peru (n=48), donors residing in South Africa (n=48), and the remaining donors residing in the Unites States including HIV⁺ donors (n=61) and HCV⁺ donors (n=26). All serum and plasma samples were stored in aliquots at −80° C. until use.

Design and cloning of viral peptide and scanning mutagenesis library sequences: For the virome peptide library, the inventors first downloaded all protein sequences in the UniProt database from viruses with human host and collapsed on 90% sequence identity. The clustering algorithm UniProt represents each group of protein sequences sharing at least 90% sequence similarity with a single representative sequence. Then, the inventors created 56 aa peptide sequences tiling through all the proteins with 28 aa overlap. The inventors reverse translated these peptide sequences into DNA codons optimized for expression in *E. coli*, making synonymous mutations when necessary to avoid restriction sites used in subsequent cloning steps (EcoRI and XhoI). Finally, the inventors added the adapter sequence "aGGAATTCCGCTGCGT" (SEQ ID NO: 14) to the 5' end and "CAGGgaagagctcgaa" (SEQ ID NO: 15) to the 3' end to form the 200 nt oligonucleotide sequences.

For the scanning mutagenesis library, the inventors first took the sequences of the peptides to be mutagenized. For each peptide, they made all single-, double-, and triple-mutants sequences scanning through the whole peptide. Non-alanine amino acids were mutated to alanine and alanines were mutated to glycine. The inventors reverse translated these peptide sequences into DNA codons, making synonymous mutations when necessary to avoid restriction sites used in subsequent cloning steps (EcoRI and XhoI). The inventors also made synonymous mutations to ensure that the 50 nt at the 5' end of peptide sequence is unique to allow unambiguous mapping of the sequencing results. Finally, the inventors added the adapter sequence "aGGAATTCCGCTGCGT" (SEQ ID NO: 14) to the 5' end and "CAGGgaagagctcgaa" (SEQ ID NO: 15) to the 3' end to form the 200 nt oligonucleotide sequences.

The 200 nt oligonucleotide sequences were synthesized on a releasable DNA microarray. DNA was PCR amplified using the primers T7-PFA (aatgatacggccggGAAT-TCCGCTGCGT) (SEQ ID NO: 16) and T7-PRA (caagcagaagACTCGAGCTCTTCCCTG) (SEQ ID NO: 17), the product was digested with EcoRI and XhoI, and the fragment was cloned into the EcoRI/SalI site of the T7FNS2 vector (8). The resulting library was packaged into T7 bacteriophage using the T7 Select Packaging Kit (EMD Millipore) and amplified using the manufacturer suggested protocol.

Phage immunoprecipitation and sequencing: The inventors performed phage immunoprecipitation and sequencing using a slightly modified version of previously published PhIP-Seq protocols (8, 10). First, the inventors blocked each well of a 96 deep-well plate with 1 mL of 3% BSA in TBST overnight on a rotator at 4° C. To each pre-blocked well, the inventors added sera or plasma containing approximately 2 g of IgG (quantified using a Human IgG ELISA Quantitation Set (Bethyl Laboratories)) and 1 mL of the bacteriophage library diluted to approximately 2×10⁵ fold representation (2×10¹⁰ pfu for a library of 10⁵ clones) in phage extraction buffer (20 mM Tris-HCl, pH 8.0, 100 mM NaCl, 6 mM MgSO₄). Two technical replicates were performed for each sample. The antibodies were permitted to bind the phage overnight on a rotator at 4° C. The next day, 20 µL each of magnetic Protein A and Protein G Dynabeads (INVITRO-GEN) was added to each well and immunoprecipitation was allowed to occur for 4 h on a rotator at 4° C. Using a 96-well magnetic stand, the beads were washed three times with 400 µL of PhIP-Seq wash buffer (50 mM Tris-HCl, pH 7.5, 150 mM NaCl, 0.1% NP-40). After the final wash, the beads were resuspended in 40 µL of water and the phage lysed at 95° C. for 10 min. We also lysed phage from the library before immunoprecipitation ("input") and after immunopre-cipitation with beads alone.

The inventors prepared the DNA for multiplexed ILLU-MINA™ sequencing using a slightly modified version of a previously published protocol (36). Two rounds of PCR amplification were performed on the lysed phage material using hot start Q5 polymerase according to the manufacturer suggested protocol (NEB). The first round of PCR used the primers IS7_HsORF5_2 (ACACTCTTTCCCTA-CACGACTCCAGTCAGGTGTGATGCTC) (SEQ ID NO: 18) and IS8_HsORF3_2 (GTGACTGGAGTTCA-GACGTGTGCTCTTCCGATCCGAGCTTATCGTCGT-CATCC) (SEQ ID NO: 19). The second round of PCR used 1 µL of the first round product and the primers IS4_HsORF5_2 (AATGATACGGCGACCACCGAGATC-TACACTCTTTCCCTACACGACTCCAGT) (SEQ ID NO: 20) and a different unique indexing primer for each sample to be multiplexed for sequencing (CAAGCAGAAGACGG-CATACGAGATxxxxxxxGTGACTGGAGTTCA-GACGTGT (SEQ ID NO: 21), where "xxxxxxx" denotes a unique 7 nt indexing sequence). After the second round of PCR, the inventors determined the DNA concentration of each sample by qPCR and pooled equimolar amounts of all samples for gel extraction. Following gel extraction, the pooled DNA was sequenced by the Harvard Medical School Biopolymers Facility using a 50 bp read cycle on an Illumina HiSeq 2000 or 2500. The inventors pooled up to 192 samples for sequencing on each lane and generally obtained approximately 100-200 million reads per lane (500,000 to 1,000,000 reads per sample).

Informatics and statistical analysis: The inventors per-formed the initial informatics and statistical analysis using a slightly modified version of the previously published tech-nique (8, 10). They first mapped the sequencing reads to the original library sequences using Bowtie and counted the frequency of each clone in the "input" and each sample "output" (37). Since the majority of clones are not enriched the inventors use the observed distribution of output counts as a null distribution. It was found that a zero-inflated generalized poisson distribution fits the output counts well. The inventors used this null distribution to calculate a p-value for the likelihood of enrichment for each clone. The probability mass function for the zero-inflated generalized poisson distribution is $$P(Y = y) = \begin{cases} \pi + (1 - \pi)\left(\theta(\theta + x\lambda)^{x-1}e^{-\theta-x\lambda}\right), & \text{if } y = 0 \\ (1 - \pi)\left(\theta(\theta + x\lambda)^{x-1}e^{-\theta-x\lambda}\right), & \text{if } y > 0 \end{cases}$$

The inventors used maximum likelihood estimation to regress the parameters $\pi$, $\theta$, and $\lambda$ to fit the distribution of counts after immunoprecipitation for all clones present at a particular frequency count in the input. This procedure was repeated for all of the observed input counts and it was found that $\theta$ and $\lambda$ are well fit by linear regression and n by an exponential regression as a function of input count (FIG.

19). Finally, for each clone the inventors used its input count and the regression results to determine the null distribution based on the zero-inflated generalized poisson model, which were used to calculate the $-\log_{10}$(p-value) of obtaining the observed count.

To call hits, the inventors determined the threshold for reproducibility between technical replicates based on a previously published method (10). Briefly, the inventors made scatter plots of the log 10 of the −log 10 (p-values) and used a sliding window of width 0.005 from 0 to 2 across the axis of one replicate. For all the clones that fell within each window, the inventors calculated the median and median absolute deviation of the log 10 of the −log 10 (p-values) in the other replicate and plotted it against the window location (FIG. 8). The inventors called the threshold for reproduc-ibility the first window in which the median was greater than the median absolute deviation. It was found that the distri-bution of the threshold −log 10 (p-value) was centered around a mean of approximately 2.3 (FIG. 9). So the inventors called a peptide a "hit" if the −log 10 (p-value) was at least 2.3 in both replicates. The inventors eliminated the 593 hits that came up in at least three of the twenty-two immunoprecipitations with beads alone (negative control for non-specific binding). The inventors also filtered out any peptides that were not enriched in at least two of the samples.

To call virus exposures, the inventors grouped peptides according to the virus the peptide is derived from. All peptides were grouped from individual viral strains for which there were complete proteomes. The sample was counted as positive for a species if it was positive for any strain from that species. For viral strains which had partial proteomes, the inventors grouped them with other strains from the same species to form a complete set and bioinfor-matically eliminated homologous peptides. A threshold number of hits per virus was set based on the size of the virus. It was found that there is approximately a power-law relationship between size of the virus and the average number of hits per sample (FIG. 10). In comparing results from VirScan to samples with known infection, it was empirically determined that a threshold of 3 hits for herpes simplex virus 1 worked the best. This value and the slope of the best fit line was used to scale the threshold for other viruses. The inventors also set a minimum threshold of at least 2 hits in order to avoid false positives from single spurious hits.

To bioinformatically remove cross-reactive antibodies, the inventors first sorted the viruses by total number of hits in descending order. The inventors then iterated through each virus in this order. For each virus, the inventors iterated through each peptide hit. If the hit shared a subsequence of at least 7 aa with any hit previously observed in any of the viruses from that sample, that hit was considered to be from a cross-reactive antibody and would be ignored for that virus. Otherwise, the hit is considered to be specific and the score for that virus is incremented by one. In this way, the inventors summed only the peptide hits that do not share any linear epitopes. The inventors compared the final score for each virus to the threshold for that virus to determine whether the sample is positive for exposure to that virus To identify differences between populations, Fisher's exact test was first used to calculate a p-value for the significance of association of virus exposure with one popu-lation versus another. Then, the inventors constructed a null-distribution of Fisher's exact p-values by randomly permuting the sample labels 1000 times and re-calculating the Fisher's exact p-value for each virus. Using this null-distribution, the false discovery rate was calculated by dividing the number of permutation p-values more extreme than the one observed by the total number of permutations.

IEDB epitope overlap analysis: The inventors downloaded data for all continuous human B cell epitopes from IEDB and filtered out all non-viral epitopes (22). To avoid redundancy in these 4,549 viral epitopes, the inventors grouped together epitopes that share a 7 aa subsequence, yielding 1,877 non-redundant epitope groups. Of these groups, 1,715 contain a member epitope that is also a subsequence of a peptide in the VirScan library. This represents the total number of epitopes that could be detected by VirScan. To determine the number of epitopes detected, the inventors tallied the number of epitope groups with at least one member that is contained in a peptide that was enriched in one or two samples. Finally, to determine the number of non-redundant new epitopes detected, the inventors grouped non-IEDB epitopes containing peptides that share a 7 residues subsequence and counted the number of these non-redundant peptide groups.

Scanning mutagenesis data analysis: First, the inventors estimated the fractional abundance of each peptide by dividing the number of reads for that peptide by the total number of reads for the sample. Then, the inventors divided the fractional abundance of each peptide after immunoprecipitation by the fractional abundance before immunoprecipitation to get the enrichment. To calculate relative enrichment, the inventors divided enrichment of the mutated peptide by enrichment of the wild-type peptide. Since most of the single-mutant peptides had wild-type levels of enrichment, the inventors averaged enrichment of the wild-type peptide enrichment with enrichment of single-mutant peptides in the middle two quartiles to get a better estimate of the wild-type peptide enrichment.

Provided herein in Table 4 are exemplary peptides from a plurality of viruses and viral families that can bind antibodies generated by a subject in response to the virus. That is, the peptides described in Table 4 act as epitopes for antibodies present in a biological sample, permitting the detection and/or identification of antibodies generated against a particular virus or plurality of viruses.

The exemplary peptides in Table 4 represent high confidence peptides containing epitopes that were found. There are ~5000 peptides, representing approximately 2000 epitopes with many variants of related peptides for viruses in a given family.

The peptides in Table 4 can be used to generate a variety of display library compositions for use with the methods as described herein. For example, a display library can comprise at least 2 peptides from Table 4, in any desired combination. In other embodiments, the display library can comprise at least 3, at least 4, at least 5, at least 6, at least 7, at least 8, at least 9, at least 10, at least 15, at least 20, at least 30, at least 40, at least 50, at least 60, at least 70, at least 80, at least 90, at least 100, at least 200, at least 300, at least 400, at least 500, at least 600, at least 700, at least 800, at least 900, at least 1000, at least 2000, at least 3000, at least 4000, at least 5000 peptides or more as selected from Table 4, in any desired combination. In some embodiments, the display library comprises all of the peptides in Table 4.

In certain embodiments, the display library can comprise peptides from at least 1 family (e.g., human herpesvirus) or sub-family (e.g., human herpesvirus 5) of related viruses. For example, the display library can be a "human herpesvirus" display library that would yield information regarding the virus or plurality of viruses a subject has been exposed to that are within the herpesvirus family. Such embodiments are particularly useful for determining the sub-type of a particular herpesvirus that a subject has been exposed to.

In another example, the display library can comprise peptides from e.g., a single sub-type of virus, such as the human herpesvirus serotype 5. This approach is particularly useful when a high sensitivity test is required since multiple epitopes for a given subtype of virus can be reflected in a relatively small sample.

Alternatively, a single peptide can be derived from each family of viruses from e.g., Table 4. This type of display library can be useful as a crude screen to determine the family of viruses to which the subject has been exposed.

In other embodiments, the display library can comprise peptides from at least 2 families, at least 3, at least 4, at least 5, at least 6, at least 7, at least 8, at least 9, at least 10, at least 11, at least 12, at least 13, at least 14; at least 15, at least 16, at least 17, at least 18, at least 19, at least 20, at least 25, at least 30, at least 35, at least 40, at least 45, or at least 50 peptides from at least 1 family (e.g., human herpesvirus) or sub-family (e.g., human herpesvirus 5) of viruses from Table 4 (e.g., at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 25, at least 30, at least 35, at least 40, at least 45, or at least 50 viral families or subtypes), in any desired combination. In one embodiment, the display library comprises peptides from each of the viral families or subfamilies in Table 4.

In one embodiment, the display library comprises all of the peptides listed in Table 4. This embodiment provides an assay of high sensitivity since it is representative of a variety of epitopes from each virus and also efficiency as it can be a high throughput means to detect the subject's exposure to a very large number of viruses in a variety of families.

Example 8: Application of the Platform to Non-Viral Antigens

Figure 20:
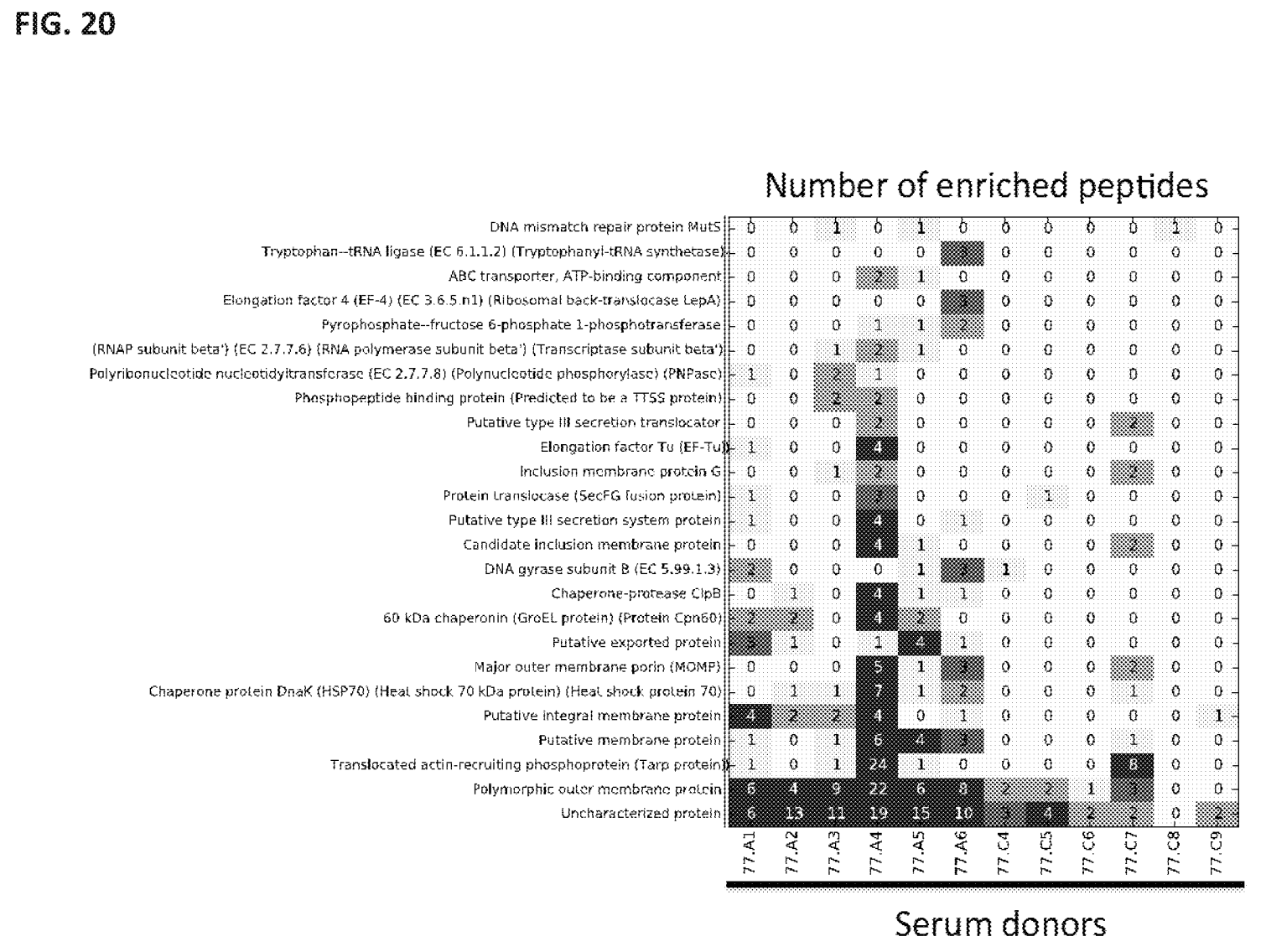

The platform has been expanded to the detection of antibodies against a variety of non-viral pathogens and antigens of interest. Specifically, a library was generated that tiles across the complete proteomes of 6 bacterial species in 56 amino acid fragments with 28 amino acid overlap. Immunoprecipitation of this library with patient serum provides genome-wide mapping of anti-bacterial antibodies. FIG. 20 shows the *Chlamydia trachomatis* proteins enriched by antibodies from 12 human donors. This experiment revealed known and novel antigenic proteins and demonstrated that this platform can be applied to detect anti-bacterial antibodies on a genome-wide scale.

Figure 21:
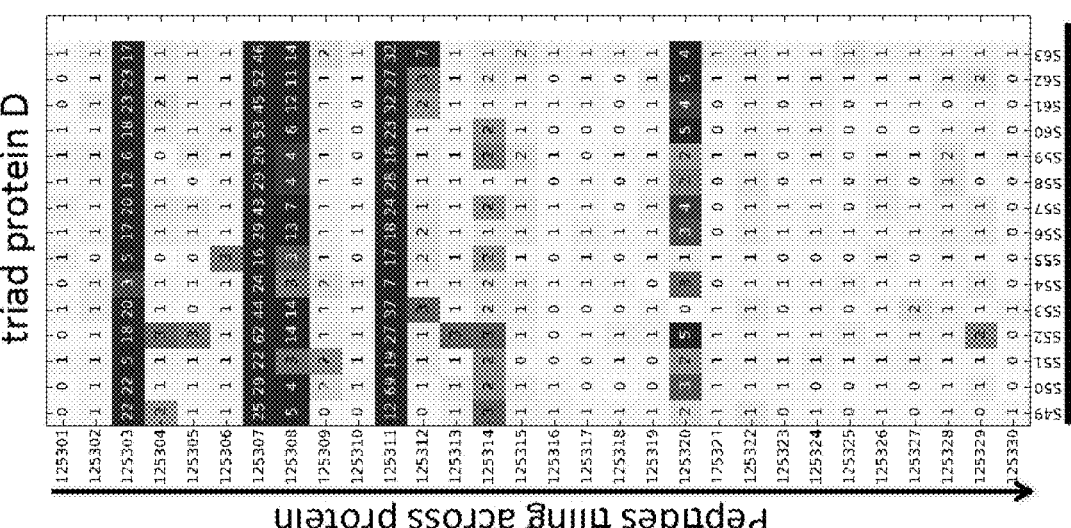
FIG. 21 The detection of antibodies to Pneumococcal histidine triad D. Each row represents a 56 amino acid peptide tiling across the protein while each column is a serum donor. The values in the heatmap show the $-\log 10$ of the pvalue of enrichment of a given peptide by the donor serum.
Figure 22:
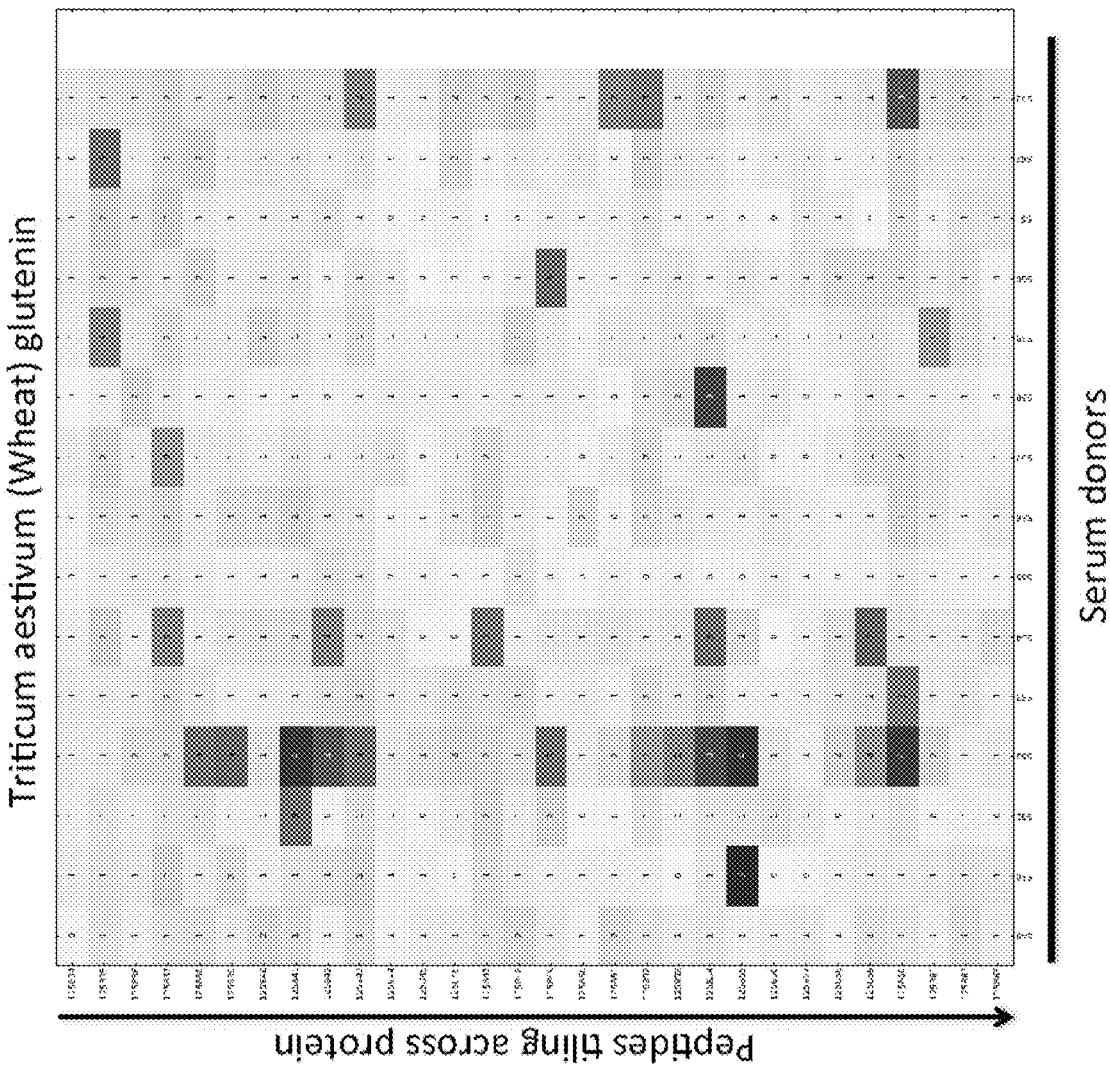
FIG. 22 The detection of antibodies to *Triticum aestivum* (Wheat) glutenin. Each row represents a 56 amino acid peptide tiling across the protein while each column is a serum donor. The values in the heatmap show the $-\log 10$ of the pvalue of enrichment of a given peptide by the donor serum.
Figure 23:
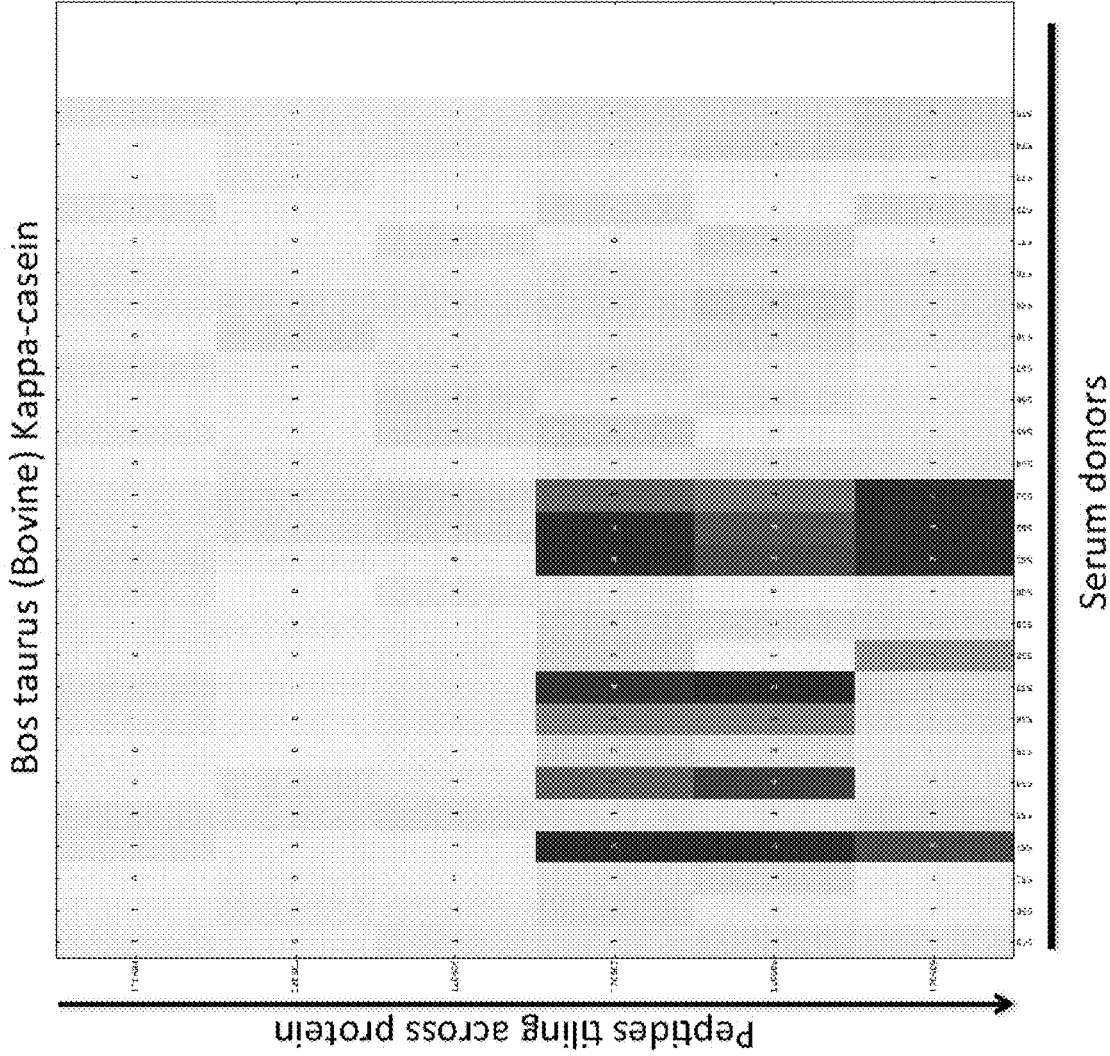
FIG. 23 The detection of antibodies to *Bos taurus* (Bovine) Kappa-casein. Each row represents a 56 amino acid peptide tiling across the protein while each column is a serum donor. The values in the heatmap show the $-\log 10$ of the pvalue of enrichment of a given peptide by the donor serum.
Figure 24B:
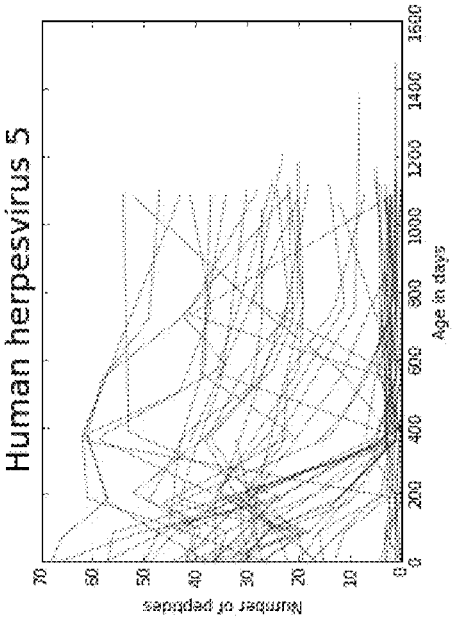
FIGS. 24A-24F Longitudinal profiling of anti-viral antibodies. The panels show the number of enriched peptides from human herpesvirus 1 (FIG. 24A), human herpesvirus 5 (FIG. 24B), human adenovirus C (FIG. 24C), human respiratory syncytial virus (FIG. 24D), rubella virus (FIG. 24E), or measles virus (FIG. 24F) (y-axis) over time, with each line representing a single child profiled serially. The antibodies present at day 0 are maternal antibodies. The spike in recognition of Rubella and Measles corresponds to the age of Measles and Rubella vaccination in the patient cohort.
Figure 24D:
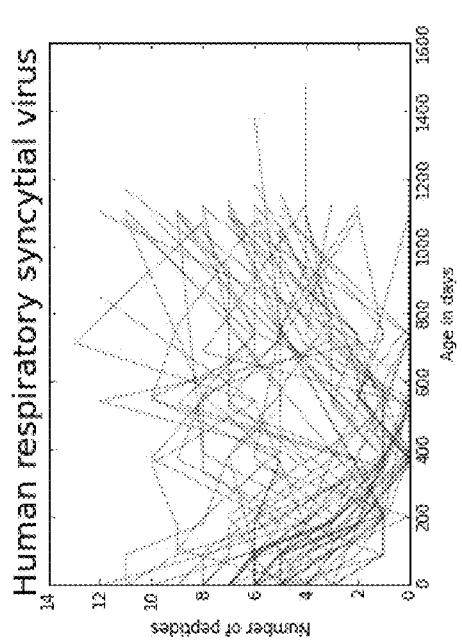
Figure 24A:
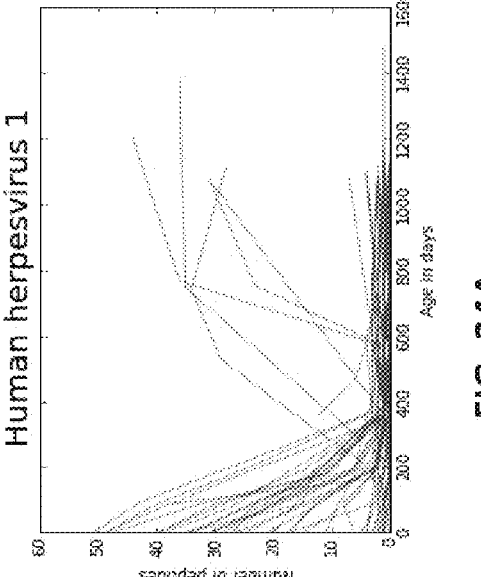
Figure 24C:
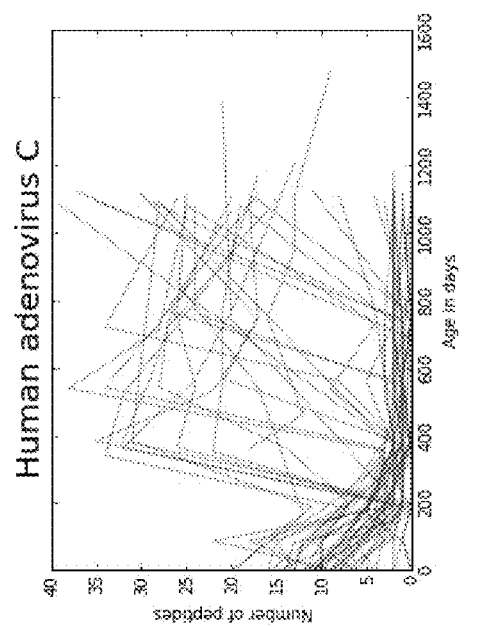
Figures 24E, 24F:
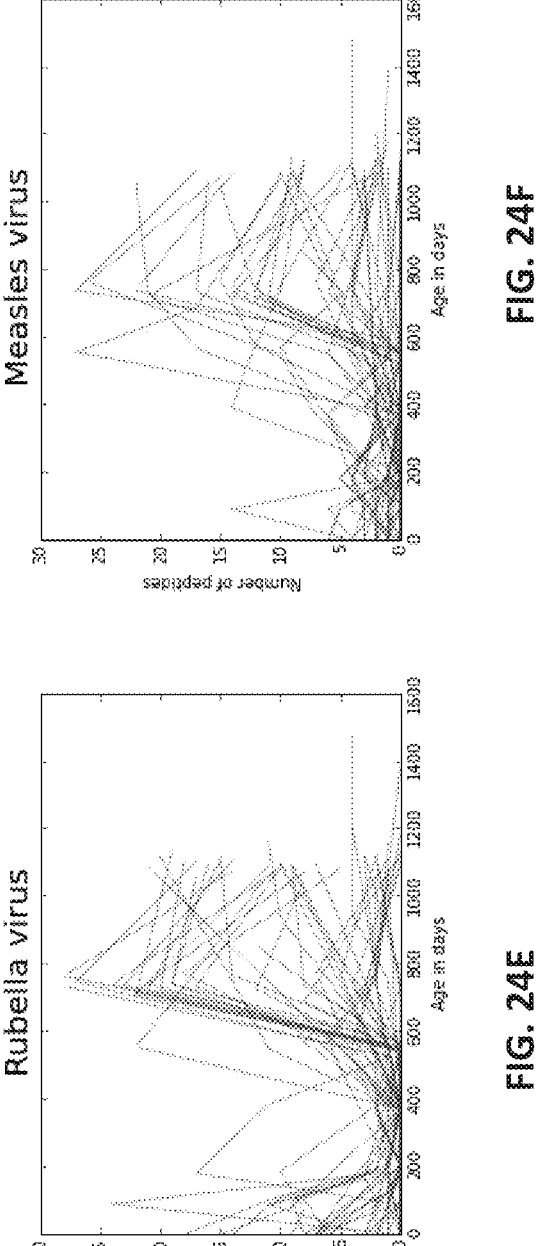

The technology is further applied to characterize the antibody response against 571 protein antigens of interest in parallel, including common allergens, antigens from bacteria, and antigens from other pathogens. It was possible to detect and map the antibody responses to these various classes of antigens as shown for Pneumococcal histidine triad protein D (FIG. 21), *Triticum aestivum* (Wheat) glutenin (FIG. 22), and *Bos taurus* (Bovine) Kappa-casein (FIG. 23). These results demonstrate that our technology can be used to profile a broad range of non-viral antibody responses simultaneously.

Example 9: Detection of Vaccine-Induced Antibodies and the Measurement of Antibody Levels Over Time The VirScan platform was used to longitudinally profile the anti-viral antibodies in a cohort of children from the time of birth to around the age of three. The inventors were able to measure the persistence of maternal antibodies, time the first exposure to various viruses, and detect vaccine-induced antibodies to Measles and Rubella (FIG. 24).

The various methods and techniques described above provide a number of ways to carry out the invention. Of course, it is to be understood that not necessarily all objectives or advantages described may be achieved in accordance with any particular embodiment described herein. Thus, for example, those skilled in the art will recognize that the methods can be performed in a manner that achieves or optimizes one advantage or group of advantages as taught herein without necessarily achieving other objectives or advantages as may be taught or suggested herein. A variety of advantageous and disadvantageous alternatives are mentioned herein. It is to be understood that some preferred embodiments specifically include one, another, or several advantageous features, while others specifically exclude one, another, or several disadvantageous features, while still others specifically mitigate a present disadvantageous feature by inclusion of one, another, or several advantageous features.

Furthermore, the skilled artisan will recognize the applicability of various features from different embodiments. Similarly, the various elements, features and steps discussed above, as well as other known equivalents for each such element, feature or step, can be mixed and matched by one of ordinary skill in this art to perform methods in accordance with principles described herein. Among the various elements, features, and steps some will be specifically included and others specifically excluded in diverse embodiments.

Although the invention has been disclosed in the context of certain embodiments and examples, it will be understood by those skilled in the art that the embodiments of the invention extend beyond the specifically disclosed embodiments to other alternative embodiments and/or uses and modifications and equivalents thereof.

Many variations and alternative elements have been disclosed in embodiments of the present invention. Still further variations and alternate elements will be apparent to one of skill in the art. Among these variations, without limitation, are systems and methods incorporating a display system for identifying antibody generation, compositions arising from the described systems and methods, and the particular use of the products created through the teachings of the invention. Various embodiments of the invention can specifically include or exclude any of these variations or elements.

In some embodiments, the numbers expressing quantities of ingredients, properties such as concentration, reaction conditions, and so forth, used to describe and claim certain embodiments of the invention are to be understood as being modified in some instances by the term "about." Accordingly, in some embodiments, the numerical parameters set forth in the written description and attached claims are approximations that can vary depending upon the desired properties sought to be obtained by a particular embodiment. In some embodiments, the numerical parameters should be construed in light of the number of reported significant digits and by applying ordinary rounding techniques. Notwithstanding that the numerical ranges and parameters setting forth the broad scope of some embodiments of the invention are approximations, the numerical values set forth in the specific examples are reported as precisely as practicable. The numerical values presented in some embodiments of the invention may contain certain errors necessarily resulting from the standard deviation found in their respective testing measurements.

In some embodiments, the terms "a" and "an" and "the" and similar references used in the context of describing a particular embodiment of the invention (especially in the context of certain of the following claims) can be construed to cover both the singular and the plural. The recitation of ranges of values herein is merely intended to serve as a shorthand method of referring individually to each separate value falling within the range. Unless otherwise indicated herein, each individual value is incorporated into the specification as if it were individually recited herein. All methods described herein can be performed in any suitable order unless otherwise indicated herein or otherwise clearly contradicted by context. The use of any and all examples, or exemplary language (e.g. "such as") provided with respect to certain embodiments herein is intended merely to better illuminate the invention and does not pose a limitation on the scope of the invention otherwise claimed. No language in the specification should be construed as indicating any non-claimed element essential to the practice of the invention.

Groupings of alternative elements or embodiments of the invention disclosed herein are not to be construed as limitations. Each group member can be referred to and claimed individually or in any combination with other members of the group or other elements found herein. One or more members of a group can be included in, or deleted from, a group for reasons of convenience and/or patentability. When any such inclusion or deletion occurs, the specification is herein deemed to contain the group as modified thus fulfilling the written description of all Markush groups used in the appended claims.

Preferred embodiments of this invention are described herein, including the best mode known to the inventors for carrying out the invention. Variations on those preferred embodiments will become apparent to those of ordinary skill in the art upon reading the foregoing description. It is contemplated that skilled artisans can employ such variations as appropriate, and the invention can be practiced otherwise than specifically described herein. Accordingly, many embodiments of this invention include all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

Furthermore, numerous references have been made to patents and printed publications throughout this specification. Each of the above cited references and printed publications are herein individually incorporated by reference in their entirety.

In closing, it is to be understood that the embodiments of the invention disclosed herein are illustrative of the principles of the present invention. Other modifications that can be employed can be within the scope of the invention. Thus, by way of example, but not of limitation, alternative configurations of the present invention can be utilized in accordance with the teachings herein. Accordingly, embodiments of the present invention are not limited to that precisely as shown and described.

---

Lengthy table referenced here

US12601088-20260414-T00001

Please refer to the end of the specification for access instructions.

LENGTHY TABLES

The patent contains a lengthy table section. A copy of the table is available in electronic form from the USPTO web site (https://seqdata.uspto.gov/docdetail?docId=US12601088B2). An electronic copy of the table will also be available from the USPTO upon request and payment of the fee set forth in 37 CFR 1.19(b)(3).

SEQUENCE LISTING (5812 sequences)

SEQ ID NO: 1 - protein, 8 aa, Artificial Sequence
  Description of Artificial Sequence: Synthetic peptide
SESDSDSD

SEQ ID NO: 2 - protein, 56 aa, Rhinovirus B
QTDALTEGLSDELEEVIVEKTKQTLASVSSGPKHTQSVPALTANETGATLPTRPSD

SEQ ID NO: 3 - protein, 36 aa, Human herpesvirus 5
TASGEEVAVLSHHDSLESRRLREEEDDDDDEDFEDA

SEQ ID NO: 4 - protein, 56 aa, Enterovirus B
IEQKQLLQGDVEEAVNRAVARVADTLPTGPRNSESIPALTAAETGHTSQVVPGDTM

SEQ ID NO: 5 - protein, 30 aa, Human herpesvirus 1
RRHTQKAPKRIRLPHIREDDQPSSHQPLFY

SEQ ID NO: 6 - protein, 56 aa, Human herpesvirus 4
SPPRRPPPGRRPFFHPVAEADYFEYHQEGGPDGEPDMPPGAIEQGPADDPGEGPST

SEQ ID NO: 7 - protein, 56 aa, Human respiratory syncytial virus
NKPSTKPRPKNPPKKPKDDYHFEVFNFVPCSICGNNQLCKSICKTIPSNKPKKKPT

SEQ ID NO: 8 - protein, 30 aa, Human adenovirus C
MTQGRRGNVYWVRDSVSGLRVPVRTRPPRN

SEQ ID NO: 9 - protein, 56 aa, Enterovirus C
QGALTLSLPKQQDSLPDTKASGPAHSKEVPALTAVETGATNPLAPSDTVQTRHVVQ

SEQ ID NO: 10 - protein, 56 aa, Human herpesvirus 3
PDPAVAPTSAASRKPDPAVAPTSAASRKPDPAVAPTSAATRKPDPAVAPTSAASRK

SEQ ID NO: 11 - protein, 56 aa, Norwalk virus
LSSMAITFKRALGARPKQPPPREILQRPPRPPTPELVKKIPPPPPNGEDELVVSYS

SEQ ID NO: 12 - protein, 56 aa, Human immunodeficiency virus 1
ERYLKDQQLLGIWGCSGKLICTTAVPWNASWSNKSLEQIWNNMTWMEWDREINNYT

SEQ ID NO: 13 - protein, 56 aa, Influenza A virus
LGHHAVPNGTLVKTITNDQIEVTNATELVQSSSTGRICDSPHRILDGKNCTLIDAL

SEQ ID NO: 14 - DNA, 16 bp, Artificial Sequence
  Description of Artificial Sequence: Synthetic oligonucleotide
aggaattccgctgcgt

SEQ ID NO: 15 - DNA, 16 bp, Artificial Sequence
  Description of Artificial Sequence: Synthetic oligonucleotide
cagggaagagctcgaa

SEQ ID NO: 16 - DNA, 27 bp, Artificial Sequence
  Description of Artificial Sequence: Synthetic primer
aatgatacggcgggaattccgctgcgt

SEQ ID NO: 17 - DNA, 27 bp, Artificial Sequence
  Description of Artificial Sequence: Synthetic primer
caagcagaagactcgagctcttccctg

SEQ ID NO: 18 - DNA, 40 bp, Artificial Sequence
  Description of Artificial Sequence: Synthetic primer
acactctttccctacacgactccagtcaggtgtgatgctc

SEQ ID NO: 19 - DNA, 53 bp, Artificial Sequence
  Description of Artificial Sequence: Synthetic primer
gtgactggagttcagacgtgtgctcttccgatccgagcttatcgtcgtcatcc

SEQ ID NO: 20 - DNA, 51 bp, Artificial Sequence
  Description of Artificial Sequence: Synthetic primer
aatgatacggcgaccaccgagatctacactctttccctacacgactccagt

SEQ ID NO: 21 - DNA, 52 bp, Artificial Sequence
  Description of Artificial Sequence: Synthetic primer
  modified_base (25)..(31): a, c, t, g, unknown or other
caagcagaagacggcatacgagatnnnnnnngtgactggagttcagacgtgt

SEQ ID NO: 22 - protein, 37 aa, Artificial Sequence
  Description of Artificial Sequence: Synthetic polypeptide
KRTPPAPQNPGGSTQAPQRVVGKSHSGIRMPAKSRNR

SEQ ID NO: 23 - protein, 36 aa, Artificial Sequence
  Description of Artificial Sequence: Synthetic polypeptide
WPGRTVKDEFGGRLDPPAASRSRRREPRRAGRWGRG

SEQ ID NO: 24 - protein, 36 aa, Artificial Sequence
  Description of Artificial Sequence: Synthetic polypeptide
MLGRSRATATWPAASRSRSLAARSLPRSPARPGPND

SEQ ID NO: 25 - protein, 36 aa, Artificial Sequence
  Description of Artificial Sequence: Synthetic polypeptide
SMPSLMTGRSAPPSPALSRSHPRTGSVQTSPSSTPV

SEQ ID NO: 26 - protein, 36 aa, Artificial Sequence
  Description of Artificial Sequence: Synthetic polypeptide
LDHGSPAQENPESEKSSPAVSRSKTFTGRFKQQTPS

SEQ ID NO: 27 - protein, 36 aa, Artificial Sequence
  Description of Artificial Sequence: Synthetic polypeptide
MSRQSSITFQSGSRRGFSTTSAITPAAGRSRFSSVS

SEQ ID NO: 28 - protein, 36 aa, Artificial Sequence
  Description of Artificial Sequence: Synthetic polypeptide
SAAPEPRPAPGRSRAMGVLMSKRQTVEQVQKVSLAV

SEQ ID NO: 29 - protein, 36 aa, Artificial Sequence
  Description of Artificial Sequence: Synthetic polypeptide
TRSRSHSPSPSQSRSRSRSRSQSPSPSPAREKLTRP

SEQ ID NO: 30 - protein, 36 aa, Artificial Sequence
  Description of Artificial Sequence: Synthetic polypeptide
AAHASLNPALFSMKMELAGSNTTASSPARARSRPLK

SEQ ID NO: 31 - protein, 36 aa, Artificial Sequence
  Description of Artificial Sequence: Synthetic polypeptide
SGGPSSCGGAPSTSRSRPSRIPQPVRHHPPVLVSSA

SEQ ID NO: 32 - protein, 36 aa, Artificial Sequence
  Description of Artificial Sequence: Synthetic polypeptide
NPGCHPSPTPMLASQRHCRDSAAVCVHVTPSPSRSL

SEQ ID NO: 33 - protein, 56 aa, Human adenovirus C
HAIRGDTFATRAEEKRAEAEAAAEAAAPAAQPEVEKPQKKPVIKPLTEDSKKRSYN

SEQ ID NO: 34 - protein, 56 aa, Influenza A virus; identical to SEQ ID NO: 13

SEQ ID NO: 35 - protein, 56 aa, Respiratory syncytial virus
STTKQRQNKPQNKPNNDFHFEVFNFVPCSICSNNPTCWAICKRIPNKKPGKKTTTK

SEQ ID NO: 36 - protein, 56 aa, Enterovirus B
GPSNSESIPALTAAETGHTSQVVPSDTIQTRHVRNFHVRSESSVENFLSRSACVYI

SEQ ID NO: 37 - protein, 56 aa, Enterovirus B
RHSVGTTLEALFQGPPVYREIKISVAPETPPPPAIADLLKSVDSEAVREYCKEKGW

SEQ ID NO: 38 - protein, 56 aa, Rhinovirus A
KQTGPITQNPVERYVDEVLNEVLVVPNINQSHPTTSNAAPVLDAAETGHTNKIQPE

SEQ ID NO: 39 - protein, 56 aa, Epstein-Barr virus; identical to SEQ ID NO: 6

SEQ ID NO: 40 - protein, 53 aa, Human adenovirus C
VPGPRPPTRRQRHDRQRGLVWEDDDSADDSSVLDLGGSGNPFAHLRPRLGRMF

SEQ ID NO: 41 - protein, 56 aa, Human herpesvirus 4; identical to SEQ ID NO: 6

SEQ ID NO: 42 - protein, 56 aa, Human herpesvirus 4
SSSSGSPPRRPPPGRRPFFHPVGDADYFEYLQEGGPDGEPDVPPGAIEQGPTDDPG

SEQ ID NO: 43 - protein, 56 aa, Human herpesvirus 4
SPPRRPPPGRRPFFHPVGEADYFEYHQEGGPDGEPDVPPGAIEQGPADDPGEGPST

SEQ ID NO: 44 - protein, 36 aa, Human herpesvirus 4
TSGATAAASAAAAVDTGSGGGGQPHDTAPRGARKKQ

SEQ ID NO: 45 - protein, 56 aa, Human herpesvirus 4
SPIHEPESHNSPEAPILFPDDWYPPSIDPADLDESWDYIFETTESPSSDEDYVEGP

SEQ ID NO: 46 - protein, 56 aa, Human herpesvirus 4
NVSPIHEPESHNSPEAPILFPDDWYPPSIDPADLDESWDYIFETTESPSSDEDYVE

SEQ ID NO: 47 - protein, 47 aa, Human herpesvirus 4
YEEFNLETTKLIAAEEGRACGETNEGLEYDEDSENDELLFLPNKKPN

SEQ ID NO: 48 - protein, 56 aa, Human herpesvirus 4
QPAPQAPYQGYQEQPPPQAPYQGYQEQPAPQAPYQGYQEPPAHGLQSSSYPGYAGP

SEQ ID NO: 49 - protein, 56 aa, Human herpesvirus 4
DSTTPRTRYNATTYLPPSTSSKLRPRWTFTSPPVTTAQATVPVPPTSQPRFSNLSM

SEQ ID NO: 50 - protein, 56 aa, Human herpesvirus 4
MKKAWLSRAQQADAGGASGSEDPPDYGDQGNVTQVGSEPISPEIGPFELSAASEDD

SEQ ID NO: 51 - protein, 56 aa, Human herpesvirus 4
QEQPAPQAPYQGYQEQPAPQAPYQGYQEQPAPQAPYQGYQEQPPPQAPYQGYQEQP

SEQ ID NO: 52 - protein, 56 aa, Human herpesvirus 4
DVAAPPAPRAPYQGYQEQPAPQAPYQGYQEQPAPQAPYQGYQEQPAPQAPYQGYQE

SEQ ID NO: 53 - protein, 56 aa, Human herpesvirus 4
LDLSLHPDVAAQPAPQAPYQGYQEPPAPQAPYQGYQEPPPPQAPYQGYQEPPAHGL

SEQ ID NO: 54 - protein, 56 aa, Human herpesvirus 4
ESHNSPEAPILFPDDWYPPSIDPADLDESWDYIFETTESPSSDEDYVEGPSKRPRP

SEQ ID NO: 55 - protein, 56 aa, Human herpesvirus 4
MSPTQPISHEEQPRYEDPDAPLDLSLHPDVAAPPAPRAPYQGYQEQPAPQAPYQGY

SEQ ID NO: 56 - protein, 56 aa, Human herpesvirus 4
PGGSGSGPRHRDGVRRPQKRPSCIGCKGAHGGTGAGGGAGAGGAGAGGAGAGGAGA

SEQ ID NO: 57 - protein, 56 aa, Human herpesvirus 4
LASSAPSTAVAQSATPSVSSSISSLRAATSGATAAASAAAAVDTGSGGGGQPHDTA

SEQ ID NO: 58 - protein, 56 aa, Human herpesvirus 4
PVGQADYFEYHQEGGPDGEPDMPPGAIEQGPADDPGEGPSTGPRGQGDGGRRKKGG

SEQ ID NO: 59 - protein, 56 aa, Human herpesvirus 4
GKHTTGHGARTSTEPTTDYGGDSTTPRPRYNATTYLPPSTSSKLRPRWTFTSPPVT

SEQ ID NO: 60 - protein, 56 aa, Human herpesvirus 4
EVVSGSPSGPRGDRSEVPGPARPGPPGIGPEGPLGQLLRRHRSPSPTRGGQEPRRV

SEQ ID NO: 61 - protein, 53 aa, Human herpesvirus 4
PTCNIKVTVCSFDDGVDLPPWFPPMVEGAAAEGDDGDDGDEGGDGDEGEEGQE

SEQ ID NO: 62 - protein, 56 aa, Human herpesvirus 4
MKKAWLSRAQQADAGGASGSEDPPDYGDQGNVQQVGSDPISPAIGPFELSAASEDD

SEQ ID NO: 63 - protein, 56 aa, Human herpesvirus 4
AGAHAHLGGSSATPVQQAQAAASAGTGALASSAPSTAVAQSATPSVSSSISSLRAA

SEQ ID NO: 64 - protein, 56 aa, Human herpesvirus 4
RRRVLVQQEEEVVSGSPSGPRGDRSEVPGPARPGPPGIGPEGPLGQLLRRHRSPSP

SEQ ID NO: 65 - protein, 56 aa, Human herpesvirus 4
PTPLPPATLTVPPRPTRPTTLPPTPLLTVLQRPTELQPTPSPPRMHLPVLHVPDQS

SEQ ID NO: 66 - protein, 56 aa, Human herpesvirus 4
MKKAWLSRAQQADAGGASGSEDPPDYGDQGNVTQVESEPISPEIGPFELSAASEDD

SEQ ID NO: 67 - protein, 23 aa, Human herpesvirus 4
SGSGPRHRDGARRPPKRPSCIGC

SEQ ID NO: 68 - protein, 56 aa, Human herpesvirus 4
ESSHLSSMSPTQPISHEEQPRYEDPDAPLDLSLHPDVAAQPAPQAPYQGYQEPPAP

SEQ ID NO: 69 - protein, 56 aa, Human herpesvirus 4
MMDPNSTSEDVKFTPDPYQVPFVQAFDQATRVYQDLGGPSQAPLPCVLWPVLPEPL

SEQ ID NO: 70 - protein, 56 aa, Human herpesvirus 4; identical to SEQ ID NO: 69

SEQ ID NO: 71 - protein, 56 aa, Human herpesvirus 4
GSRESPSLPSSKKGADEFEAWLEAQDANFEDVQREFSGLRVIGDEDEDGSEDGEFS

SEQ ID NO: 72 - protein, 37 aa, Human herpesvirus 4
PADLDESWDYIFETTESPSSDEDYVEGPSKRPRPSIQ

SEQ ID NO: 73 - protein, 56 aa, Human herpesvirus 4
EEEVVSGSPSGPRGDRSEVPGPARPGPPGIGPEGPLGQLLRRHRSPSPTRGGQEPR

SEQ ID NO: 74 - protein, 56 aa, Human herpesvirus 4
HEPESSDSEEPPFLFPSDWYPPTLEPAELDESWEGIFETTESHSSDEENVGGPSKR

SEQ ID NO: 75 - protein, 56 aa, Human herpesvirus 4
ENSPTPGPSTAGPVCRVTPSATPDISPIHEPESSDSEEPPFLFPSDWYPPTLEPAE

SEQ ID NO: 76 - protein, 56 aa, Human herpesvirus 4
YFDIPLTEPINQGASAAHFLPQQPMEGPLVPEQWMFPGAALSQSVRPGVAQSQYFD

SEQ ID NO: 77 - protein, 56 aa, Human herpesvirus 4
YHANRTLTQRMHLTVIPATTIAPTTLVSHTTSTSHRPHRRPVSKRPTHKPVTLGPF

SEQ ID NO: 78 - protein, 56 aa, Human herpesvirus 4
TGSSQAAPSSSSVAPVASLSGDLEEEEEGSRESPSLPSSKKGADEFEAWLEAQDAN

SEQ ID NO: 79 - protein, 56 aa, Human herpesvirus 4
HVPDQSMHPLTHQSTPNDPDSPEPRSPTVFYNIPPMPLPPSQLPPPAAPAQPPPGV

SEQ ID NO: 80 - protein, 56 aa, Human herpesvirus 4
MSAPRKVRLPSVKAVDMSMEDMAARLARLESENKALKQQVLRGGACASSTSVPSAP

SEQ ID NO: 81 - protein, 56 aa, Human herpesvirus 4
QAPYQGYQEPPPPQAPYQGYQEPPAHGLQSSSYPGYAGPWTPRSQHPCYRHPWAPW

SEQ ID NO: 82 - protein, 56 aa, Human herpesvirus 4
VLQRPTELQPTPSPPRMHLPVLHVPDQSMHPLTHQSTPNDPDSPEPRSPTVFYNIP

SEQ ID NO: 83 - protein, 56 aa, Human herpesvirus 4
EYLQEGGPDGEPDVPPGAIEQGPTDDPGEGPSTGPRGQGDGGRRKKGGWFGKHRGQ

SEQ ID NO: 84 - protein, 39 aa, Human herpesvirus 4
IDPADLDESWDYIFETTESPSSDEDYVEGPSKRPRPSIQ

SEQ ID NO: 85 - protein, 56 aa, Human herpesvirus 4
PRSPSQMSVRDRLARLRAEAQVKQASVEVQPPQLTQVSPQQPMEGPLVPEQQMFPG

SEQ ID NO: 86 - protein, 56 aa, Human herpesvirus 4
PRVRGGGRVSAAAITWVPKPNVEVWPVDPPPPVNFNKTAEQEYGDKEIKLPHWTPT

SEQ ID NO: 87 - protein, 56 aa, Human herpesvirus 4
GGPDGEPDVPPGAIEQGPADDPGEGPSTGPRGQGDGGRRKKGGWFGKHRGQGGSNP

SEQ ID NO: 88 - protein, 56 aa, Human herpesvirus 4
MDKDRPGPPALDDNMEEEVPSTSVVQEQVSAGDWENVLIELSDSSSEKEAEDAHLE

SEQ ID NO: 89 - protein, 38 aa, Human herpesvirus 4
PPWFPPMVEGAAAEGDDGDDGDDGDEGGDGDEGEEGQE

SEQ ID NO: 90 - protein, 56 aa, Human herpesvirus 4
SRERARGRGRGRGEKRPRSPSSQSSSSGSPPRRPPPGRRPFFHPVAEADYFEYHQE

SEQ ID NO: 91 - protein, 56 aa, Human herpesvirus 4
TIPEAGAAGNSGPREDTNPQQPTTEGHHRGKKLVQASASGVAQSKEPTTPKAKSVS

SEQ ID NO: 92 - protein, 56 aa, Human herpesvirus 4
PPRPTPPTPLPPATLTVPPRPTRPTTLPPTPLLTVLQRPTELQPTPSPPRMHLPVL

SEQ ID NO: 93 - protein, 56 aa, Human herpesvirus 4
LPQQPMEGPLVPERWMFQGATLSQSVRPGVAQSQYFDLPLTQPINHGAPAAHFLHQ

SEQ ID NO: 94 - protein, 56 aa, Human herpesvirus 4
VPGPARPGPPGIGPEGPLGQLLRRHRSPSPTRGGQEPRRVRRRVLVQQEEEVVSGS

SEQ ID NO: 95 - protein, 56 aa, Human herpesvirus 4
TMQPPPRAPTPMPPPQGPPTAMQRPQGAPTPMPPPQGPPTAMQRPRGAPTPMPPPQ

SEQ ID NO: 96 - protein, 56 aa, Human herpesvirus 4
PSTSSKLRPRWTFTSPPVTTAQATVPVPPTSQPRFSNLSMLVLQWASLAVLTLLLL

SEQ ID NO: 97 - protein, 56 aa, Human herpesvirus 4
PTPGPSNAAPVCRNSHTATPNVSPIHEPESHNSPEAPILFPDDWYPPSIDPADLDE

SEQ ID NO: 98 - protein, 56 aa, Human herpesvirus 4
PQGQLTAYHVSAAPTGSWFPAPQPAPENAYQAYAAPQLFPVSDITQNQQTNQAGGE

SEQ ID NO: 99 - protein, 56 aa, Human herpesvirus 4
PTPMSPPEVPPVPRQRPRGAPTPTPPPQVPPVPRQRPRGAPTPTPPPQVLPTPMQL

SEQ ID NO: 100 - protein, 56 aa, Human herpesvirus 4; identical to SEQ ID NO: 98

SEQ ID NO: 101 - protein, 56 aa, Human herpesvirus 4
PWQPLPGPQVTAVLLHEESMQGVQVHGSMLDLLEKDDEVMEQRVMATLLPPVPQQP

SEQ ID NO: 102 - protein, 56 aa, Human herpesvirus 4
MGDRSEVPGPARPGPPGIGPEGPLGQLLRRHRSPSPTRGGQEPRRVRRRVLVQQEE

SEQ ID NO: 103 - protein, 56 aa, Human herpesvirus 4
APQAPYQGYQEPPAHGLQSSSYPGYAGPWTPRSQHPCYRHPWAPWSQDPVHGHTQG

SEQ ID NO: 104 - protein, 56 aa, Human herpesvirus 4
LPLTQPINHGAPAAHFLHQPPMEGPWVPEQWMFQGAPPSQGTDVVQHQLDALGYTL

SEQ ID NO: 105 - protein, 56 aa, Human herpesvirus 4
PPYYGSHLRADYVPAPSRSNKRKRDPEEDEEGGGLFPGEDATLYRKDIAGLSKSVN

SEQ ID NO: 106 - protein, 56 aa, Human herpesvirus 4
RTSTEPTTDYGDDSTTPRPRYNATTYLPPSTSSKLRPRWTFTSPPVTTAQATVPVP

SEQ ID NO: 107 - protein, 56 aa, Human herpesvirus 4
SDAGPPSTRPRVMAPPSTGPRVMATPSTGPRDMAPPSTGPRDMAPPSTGPRDMAPP

SEQ ID NO: 108 - protein, 56 aa, Human herpesvirus 4
PYQPTPTGPATMLLRQWAPATMQTPPRAPTPMSPPEVPPVPRQRPRGAPTPTPPPQ

SEQ ID NO: 109 - protein, 56 aa, Human herpesvirus 4
PLPGPQVTTVLLHEESMQGVQVHGSMLDLLEKDDEVMEQRVMATLLPPVPQQPRAG

SEQ ID NO: 110 - protein, 56 aa, Human herpesvirus 4
RKPGGPWRPEPNTSSPSMPELSPVLGLHQGQGAGDSPTPGPSNAAPVCRNSHTATP

SEQ ID NO: 111 - protein, 56 aa, Human herpesvirus 4
PERPGPSEQSSVTVEPAHPTPVEMPMVILHQPPPVPKPVPVKPTPPPSRRRRGACV

SEQ ID NO: 112 - protein, 56 aa, Human herpesvirus 4
VPPPEPLTARQREVMITQATGRLASQAMKKIEDKVRKSVDGVTTRNEMENILQNLT

SEQ ID NO: 113 - protein, 56 aa, Human herpesvirus 4
ETAAPRQWPMPLRPIPMRPLRMQPIPFNHPVGPTPHQTPQVEITPYKPTWAQIGHI

SEQ ID NO: 114 - protein, 56 aa, Human herpesvirus 4
IAMQGPGETSGIRRARERWRPAPWTPNPPRSPSQMSVRDRLARLRAEAQVKQASVE

SEQ ID NO: 115 - protein, 56 aa, Human herpesvirus 4
DEDESGEGSDTSEPCEALDLSIHGRPCPQAPEWPVQEEGGQDATEVLDLSIHGRPR

SEQ ID NO: 116 - protein, 56 aa, Human herpesvirus 4
PPVPATQPQYFDIPLTEPINQGASAAHFLPQQPMEGPLVPERWMFQGATLSQSVRP

SEQ ID NO: 117 - protein, 56 aa, Human herpesvirus 4
TRGGQEPRRVRRRVLVQQEEEVVSGSPSGPRGDRSEVPGPARPGPPGIGPEGPLGQ

SEQ ID NO: 118 - protein, 56 aa, Human herpesvirus 4
QGNVQQVGSDPISPAIGPFELSAASEDDPQSGPVEENLDAAAREEEEPDEQEHNGG

SEQ ID NO: 119 - protein, 56 aa, Human herpesvirus 4
QGPADDPGEGPSTGPRGQGDGGRRKKGGWFGKHRGQGGSNQKFENIADGLRTLLAR

SEQ ID NO: 120 - protein, 56 aa, Human herpesvirus 4
MDKDRPGLPAPDDNIEEVPSTSGVQERASEGDWENVLIEISDSSSEEEAEDAHLEP

SEQ ID NO: 121 - protein, 56 aa, Human herpesvirus 4
QAPEWPVQEEGGQDATEVLDLSIHGRPRPRTPEWPVQGEGGQNVTGPETRRVVVSA

SEQ ID NO: 122 - protein, 56 aa, Human herpesvirus 4
PGGSGSGPRHRDGVRRPQKRPSCIGCKGTHGGTGAGAGAGGAGAGGAGAGGGAGAG

SEQ ID NO: 123 - protein, 56 aa, Human herpesvirus 4
GEGPSTGPRGQGDGGRRKKGGWFGKHRGQGGSNPKFENIADSLRALLARSHVERTT

SEQ ID NO: 124 - protein, 56 aa, Human herpesvirus 4
PPMEGPWVPEQWMFQGAPPSQGTDVVQHQLDDLGYPLHDLNHPGVPVSPAVNQYHF

SEQ ID NO: 125 - protein, 56 aa, Human herpesvirus 4
RPAPWTPNPPRSPSQMSVRDRLARLRAEAQARQASVEVQPTQLTQVSPQQPMERPL

SEQ ID NO: 126 - protein, 56 aa, Human herpesvirus 4
GVAQSQYFDLPLTQPINHGAPAAHFLHQPPMEGPWVPEQWMFQGAPPSQGTDVVQH

SEQ ID NO: 127 - protein, 56 aa, Human herpesvirus 4
SEEEDEDPTPAHTIPARPSSVVITPTSASFVIPRKKWDLQDKTVTLHRSPLCRDED

SEQ ID NO: 128 - protein, 56 aa, Human herpesvirus 4
ATRVYQDLGGPSQAPLPCVLWPVLPEPLPQGQLTAYHVSAAPTGSWFPAPQPAPEN

SEQ ID NO: 129 - protein, 56 aa, Human herpesvirus 4
RYNATTYLPPSTSSKLRPRWTFTSPPVTTAQATVPVPPTSQPRFSNLSMLVLQWAS

SEQ ID NO: 130 - protein, 56 aa, Human herpesvirus 4
IDPNMEPVQQRPVMFVSRVPAKKPRKLPWPTPKTHPVKRTNVKTSDRSDKAEAQST

SEQ ID NO: 131 - protein, 56 aa, Human herpesvirus 4
YQPQMGHIPYQPRPTGHSTMLRPQWAPTTMQPPPRAPTPMPPPQGPPTAMQRPQGA

SEQ ID NO: 132 - protein, 56 aa, Human herpesvirus 4
VPPLRPTAPTILSPLSQPRLTPPQPLMMPPRPTPPTPLPPATLTVPPRPTRPTTLP

SEQ ID NO: 133 - protein, 56 aa, Human herpesvirus 4
SPTRGGQEPRRVRRRVLVQQEEEVVSGSPSGPRGDRSEVPGPARPGPPGIGPEGPL

SEQ ID NO: 134 - protein, 56 aa, Human herpesvirus 4
PSGPRGDRSEVPGPARPGPPGIGPEGPLGQLLRRHRSPSPTRGGQEPRRVRRRVLV

SEQ ID NO: 135 - protein, 56 aa, Human herpesvirus 4
SRERARGRGRGRGEKRPRSPSSQSSSSGSPPRRPPPGRRPFFHPVGEADYFEYHQE

SEQ ID NO: 136 - protein, 56 aa, Human herpesvirus 4
PTPMPPPQGPPTAMQRPRGAPTPMPPPQGPPTAMQLSPRALTGQKGPAKHILRQLL

SEQ ID NO: 137 - protein, 56 aa, Human herpesvirus 4
MESFEGQGDSRQSPDNERGDNVQTTGEHDQDPGPGPPSSGASERLVPEESYSRDQQ

SEQ ID NO: 138 - protein, 56 aa, Human herpesvirus 4
MSPPEVPPVPRQRPRGAPTPTPPPQVLPTPMQLALRAPAGQQGPTKQILRQLLTGG

SEQ ID NO: 139 - protein, 56 aa, Human herpesvirus 4
PQYFDLPLTQPISQGAPAAPLRASMGPVPPVPATQPQYFDIPLTEPINQGASAAHF

SEQ ID NO: 140 - protein, 56 aa, Human herpesvirus 4
MDKDRPGLPAPDDNIEEVPSTSGVQERASEGDWENVLIEISDSSSEEEAEDAHLDS

SEQ ID NO: 141 - protein, 56 aa, Human herpesvirus 4
MHPLTHQSTPNDPDSPEPRSPTVFYNIPPMPLPPSQLPPPAAPAQPPPGVINDQQL

SEQ ID NO: 142 - protein, 56 aa, Human herpesvirus 4
RVRRRVLVQQEEEVVSGSPSGPRGDRSEVPGPARPGPPGIGPEGPLGQLLRRHRSP

SEQ ID NO: 143 - protein, 56 aa, Human herpesvirus 4; identical to SEQ ID NO: 130

SEQ ID NO: 144 - protein, 56 aa, Human herpesvirus 4
QGNVTQVGSEPISPEIGPFELSAASEDDPQSGPVEENLDAAAREEEEPHEQEHNGG

SEQ ID NO: 145 - protein, 56 aa, Human herpesvirus 4
MGALWSLCRRRVNSIGDVDGGIINLYNDYEEFNLETTKLIAAEEGRACGETNEGLE

SEQ ID NO: 146 - protein, 56 aa, Human herpesvirus 4
GGPDGEPDMPPGAIEQGPADDPGEGPSTGPRGQGDGGRRKKGGWYGKHRGEGGSSQ

SEQ ID NO: 147 - protein, 56 aa, Human herpesvirus 4
MPVEPVPVPTVALERPVYPKPVRPAPPKIAMQGPGETSGIRRARERWRPAPWTPNP

SEQ ID NO: 148 - protein, 56 aa, Human herpesvirus 4
QASGPGNSSTSTKPGEVNVTKGTPPQNATSPQAPSGQKTAVPTVTSTGGKANSTTG

SEQ ID NO: 149 - protein, 56 aa, Human herpesvirus 4
SQAAFGLPIDEDESGERSDTSEPYEALDLSIHGRPCPQAPEWPVQGEGGQDATEVL

SEQ ID NO: 150 - protein, 56 aa, Human herpesvirus 4
TAPTILSPLSQPRLTPPQPLMMPPRPTPPTPLPPATLTVPPRPTRPTTLPPTPLLT

SEQ ID NO: 151 - protein, 50 aa, Human herpesvirus 4
LRIQVSMLGAKGQPSPGEGTRPRESNDPNATRRARSRSRGREAKKVQISD

SEQ ID NO: 152 - protein, 56 aa, Human herpesvirus 4
QPISQGAPVAPLRASMGPVPPVPATQPQYFDIPLTEPINQGASAAHFLPQQPMEGP

SEQ ID NO: 153 - protein, 56 aa, Human herpesvirus 4
RQMSQQPVQMLYPGIDELAQQHASGEGPGINPISKTELQAIMLALHEQNQEQKRAA

SEQ ID NO: 154 - protein, 56 aa, Human herpesvirus 4
EPEQQMFPGSPFSQVADVARESGVPAMQPQYFDLPLTQPISQGAPAAPLRASMGPV

SEQ ID NO: 155 - protein, 56 aa, Human herpesvirus 4
IDPNMEPVQQRPVMFVSRVPVRKPRTLPWPTPKTHPVKRTIVKTSYRSDEAEEAQS

SEQ ID NO: 156 - protein, 56 aa, Human herpesvirus 4
LSIHGRPCPQAPEWPVQGEGGQDATEVLDLSIHGRPRPRTPEWPVQGESGQNVTDH

SEQ ID NO: 157 - protein, 56 aa, Human herpesvirus 4; identical to SEQ ID NO: 111

SEQ ID NO: 158 - protein, 56 aa, Human herpesvirus 4
PGTTSQASGPGNSSTSTKPGEVNVTKGTPPKNATSPQAPSGQKTAVPTVTSTGGKA

SEQ ID NO: 159 - protein, 33 aa, Human herpesvirus 4
EGPSTGPRGQGDGGRRKKGGWFGKHRGQGGSNP

SEQ ID NO: 160 - protein, 56 aa, Human herpesvirus 4
RPVCPAPPEIAMQGPGEPSGIKRTRERWRPAPWTPNPPRSPSQMSVRDRLARLRAE

SEQ ID NO: 161 - protein, 56 aa, Human herpesvirus 4
APTVVLQRPPTQQEPGPVGPLSVQARLEPWQPLPGPQVTAVLLHEESMQGVQVHGS

SEQ ID NO: 162 - protein, 56 aa, Human herpesvirus 4
QLDDLGYPLHDLNHPGVPVSPAVNQYHFSQAAFGLPIDEDESGERSDTSEPYEALD

SEQ ID NO: 163 - protein, 56 aa, Human herpesvirus 4
HGLNHPGVPVSPAVNQYHLSQAAFGLPIDEDESGEGSDTSEPCEALDLSIHGRPCP

SEQ ID NO: 164 - protein, 56 aa, Human herpesvirus 4
TSTKPGEVNVTKGTPPKNATSPQAPSGQKTAVPTVTSTGGKANSTTGGKHTTGHGA

SEQ ID NO: 165 - protein, 56 aa, Human herpesvirus 4
MESFEGEGDSIQSPDNARGDDVQNTGEHIQDPGPGPSTGGASEGLVQNEPDSRDQQ

SEQ ID NO: 166 - protein, 53 aa, Human herpesvirus 4
PTCNIRVTVCSFDDGVDLPPWFPPMVEGAAAEGDDGDDGDEGGDGDEGEEGQE

SEQ ID NO: 167 - protein, 56 aa, Human herpesvirus 4
MTLSPEPLPPPAAPAHPLPGVIYDQQALPPTPGPPWWPPVRDPTPTTQTPPTNTKQ

SEQ ID NO: 168 - protein, 56 aa, Human herpesvirus 4
GPRGQGDGGRRKKGGWFGKHRGQGGSNPKFENIAEGLRALLARSHVERTTDEGTWV

SEQ ID NO: 169 - protein, 56 aa, Human herpesvirus 4
PPAPAPVRGRASAPPRPPAPVQQSTKDKGPHRPTRPVLRGPAPRRPPPPSSPNTYN

SEQ ID NO: 170 - protein, 56 aa, Human herpesvirus 4
PRPGTTSQASGPGNSSTSTKPGEVNVTKGTPPKNATSPQAPSGQKTAVPTVTSTGG

SEQ ID NO: 171 - protein, 34 aa, Human herpesvirus 4
LDESWEGIFETTESHSSDEENVGGPSKRPRTSTQ

SEQ ID NO: 172 - protein, 56 aa, Human herpesvirus 4
VSAGDWENVLIELSDSSSEKEAEDAHLEPAQKGTKRKRVDHDAGGSAPARPMLPPQ

SEQ ID NO: 173 - protein, 56 aa, Human herpesvirus 4
APRQWPMPLRPIPMRPLRMQPIPFNHPVGPTPHQTPQVEITPYKPTWAQIGHIPYQ

SEQ ID NO: 174 - protein, 56 aa, Human herpesvirus 4
ADDPGEGPSTGPRGQGDGGRRKKGGWFGKHRGQGGSNPKFENIAEGLRTLLARSHV

SEQ ID NO: 175 - protein, 56 aa, Human herpesvirus 4
FEDVQREFSGLRVIGDEDEDGSEDGEFSDLDLSDSDHEGDEGGGAVGGGRSLHSLY

SEQ ID NO: 176 - protein, 56 aa, Human herpesvirus 4; identical to SEQ ID NO: 137

SEQ ID NO: 177 - protein, 56 aa, Human herpesvirus 4
HTTSTSHRPHRRPVSKRPTHKPVTLGPFPIDPWRPKTTWVHWALLLITCAVVAPVL

SEQ ID NO: 178 - protein, 56 aa, Human herpesvirus 4
PVSETVELELESEPRPRPSRTPSPGRNRRRSSTSSSSSRSTRRQRPVSTQALVSSV

SEQ ID NO: 179 - protein, 56 aa, Human herpesvirus 4
APSCAQTPWPVVQPSQTPDDPTKQSRPPETAAPRQWPMPLRPIPMRPLRMQPIPFN

SEQ ID NO: 180 - protein, 56 aa, Human herpesvirus 4
GPARPGPPGIGPEGPLGQLLRRHRSPSPTRGGQEPRRVRRRVLVQQEEEVVSGSPS

SEQ ID NO: 181 - protein, 56 aa, Human herpesvirus 4
RPSLVTNCTAPLKTSVKGPNWSGAAGGMKRKQCRVDRLTDRSFPAYLEEVMYVMVQ

SEQ ID NO: 182 - protein, 45 aa, Human herpesvirus 4
RGKKLVQASASGVAQSKEPTTPKAKSVSAHLKSIFCEELLNKRVA

SEQ ID NO: 183 - protein, 56 aa, Human herpesvirus 4
PTGGENITQVTPASTSTHHVSTSSPAPRPGTTSQASGPGNSSTSTKPGEVNVTKGT

SEQ ID NO: 184 - protein, 56 aa, Human herpesvirus 4
PQSGPVEENLDAAAREEEEPHEQEHNGGDDPLDVHTRQPRFVDVNPTQAPVIQLVH

SEQ ID NO: 185 - protein, 56 aa, Human herpesvirus 4
YEEYVQRTFGVPRRQRAIDKRQRASVAGAGAHAHLGGSSATPVQQAQAAASAGTGA

SEQ ID NO: 186 - protein, 56 aa, Human herpesvirus 4
APFSQVADVVRAPGVPAMQPQYFDLPLIQPISQGAPVAPLRASMGPVPPVPATQPQ

SEQ ID NO: 187 - protein, 56 aa, Human herpesvirus 4
SAAPASAAPASAAPASAAPASAAQASVAPASVAPASAAPASAAPDSAAPASSPPLF

SEQ ID NO: 188 - protein, 56 aa, Human herpesvirus 4; identical to SEQ ID NO: 128

SEQ ID NO: 189 - protein, 56 aa, Human herpesvirus 4
PMPLPPSQLPPPAAPAQPPPGVINDQQLHHLPSGPPWWPPICDPPQPSKTQGQSRG

SEQ ID NO: 190 - protein, 56 aa, Human herpesvirus 4
AHPTGGENITQVTPASTSTHHVSTSSPAPRPGTTSQASGPGNSSTSTKPGEVNVTK

SEQ ID NO: 191 - protein, 41 aa, Human herpesvirus 4
RRSSTSSSSSRSTRRQRPVSTQALVSSVLPMTTDSEEEIFP

SEQ ID NO: 192 - protein, 56 aa, Human herpesvirus 4
PAGPIVRPWEPSLTQAAGQAFAPVRPQHMPVEPVPVPTVALERPVYPKPVRPAPPK

SEQ ID NO: 193 - protein, 56 aa, Human herpesvirus 4
ETEAPRQWPMPLRPIPLHPLRMQPISFNPAVRPTPHQPPQVEPTFYQSTWVKPPQQ

SEQ ID NO: 194 - protein, 56 aa, Human herpesvirus 4
NITQVTPASISTHHVSTSSPAPRPGTTSQASGPGNSSTSTKPGEVNVTKGTPPQNA

SEQ ID NO: 195 - protein, 56 aa, Human herpesvirus 4
PQSGPVEENLDAAAREEEEPDEQEHNGGDDPLEVHTRQPRFVDVNPTQAPVIQLVH

SEQ ID NO: 196 - protein, 56 aa, Human herpesvirus 4
SFVIPRKKWDLQDKTVTLHRSPLCRDEDEKEETGNSSYTRGHKRRRGEVHGCTDES

SEQ ID NO: 197 - protein, 56 aa, Human herpesvirus 4
IKDLVMPKPAPTCNIKATVCSFDDGVDLPPWFPPMVEGAAAEGDDGDDGDDGDEGG

SEQ ID NO: 198 - protein, 56 aa, Human herpesvirus 4
QGNVTQVESEPISPEIGPFELSAASEDDPQSGPVEENLDAAAREEEEPHEQEHNGG

SEQ ID NO: 199 - protein, 56 aa, Human herpesvirus 4
APTVVLQRPPTQQEPGPAGPLSVLEPWQPLPGPQVTTVLLHEESMQGVQVHGSMLD

SEQ ID NO: 200 - protein, 56 aa, Human herpesvirus 4
QGQGAGDSPTPGPSNAAPVCRNSHTATPNVSPIHEPESHNSPEAPILFPDDWYPPS

SEQ ID NO: 201 - protein, 56 aa, Human herpesvirus 4
ISTHHVSTSSPAPRPGTTSQASGPGNSSTSTKPGEVNVTKGTPPKNATSPQAPSGQ

SEQ ID NO: 202 - protein, 56 aa, Human herpesvirus 4
PPPPVNFNKTAEQEYGDKEIKLPHWTPTLHTFQVPKNYTKANCTYCNTREYTFSYK

SEQ ID NO: 203 - protein, 56 aa, Human herpesvirus 4
CAQTPWPVVQPSQTPDDPTKQSRPPETAAPRQWPMPLRPIPMRPLRMQPIPFNHPV

SEQ ID NO: 204 - protein, 56 aa, Human herpesvirus 4
PVGHPAAPRAPGPEPRTRLQPATPRRSGAADPADPVGHPAAPRAPGPEPRTRLQPA

SEQ ID NO: 205 - protein, 56 aa, Human herpesvirus 4
WPTPKTHPVKRTNVKTSDRSDKAEAQSTPERPGPSEQSSVTVEPAHPTPVEMPMVI

SEQ ID NO: 206 - protein, 56 aa, Human herpesvirus 4
SPPPPPRTPTWESPARPETPSPAIPSHSSNTALERPLAVQLARKRTSSEARQKQKH

SEQ ID NO: 207 - protein, 56 aa, Human herpesvirus 4
SEGDWENVLIEISDSSSEEEAEDAHLEPSQRGKKRKRVDDDAGGSAPAQHVPPPQL

SEQ ID NO: 208 - protein, 56 aa, Human herpesvirus 4
EPEDKSPRVQPLGTGLQQRPRHTVSPSPSPPPPPRTPTWESPARPETPSPAIPSHS

SEQ ID NO: 209 - protein, 56 aa, Human herpesvirus 4
GPRDMAPPSTGPRDMAPPSTGPRDMAPPSTGPRDMAPTVVHMFTRERLLTQSTGPA

SEQ ID NO: 210 - protein, 56 aa, Human herpesvirus 4
PAPSPPPTQQQPPQSAAPAPSPLLPQQQPPPSAAPAPSPLLPQQQPPPSAARAPSP

SEQ ID NO: 211 - protein, 56 aa, Human herpesvirus 4
PGPEPRTRLQPATPRRSGAADPADPVGHPAAPRAPGPEPRTRLQPATPRRSGAADP

SEQ ID NO: 212 - protein, 56 aa, Human herpesvirus 4
LVPEQWMFPGAALSQSVRPGVAQSQYFDLPLTQPINHGAPAAHFLHQPPMEGPWVP

SEQ ID NO: 213 - protein, 56 aa, Human herpesvirus 4
PEPRTRLQPATPRRSGAADPADPVGHPAAPRAPGPEPRTRLQPATPRRSGAADPAD

SEQ ID NO: 214 - protein, 56 aa, Human herpesvirus 4; identical to SEQ ID NO: 137

SEQ ID NO: 215 - protein, 56 aa, Human herpesvirus 4; identical to SEQ ID NO: 204

SEQ ID NO: 216 - protein, 56 aa, Human herpesvirus 4; identical to SEQ ID NO: 205

SEQ ID NO: 217 - protein, 56 aa, Human herpesvirus 4
DRGLILPQGPQTAPQAMLVQPHVPPLRPTAPTILSPLSQPRLTPPQPLMMPPRPTP

SEQ ID NO: 218 - protein, 56 aa, Human herpesvirus 4
ALRAPAGQQGPTKQILRQLLTGGVKKGRPSLKLQAALERQAAAGWQPSPGSGTSDK

SEQ ID NO: 219 - protein, 56 aa, Human herpesvirus 4
PLLEKVAPGRPRDWLSPTSSPRDVTVTPGLAAPITLPGPRLMARPYFGAETRASES

SEQ ID NO: 220 - protein, 56 aa, Human herpesvirus 4
VKKGRPSLKLQAALERQAAAGWQPSPGSGTSDKIVRAPIFYPPVLQPIQVMGQGGS

SEQ ID NO: 221 - protein, 56 aa, Human herpesvirus 4
KDAIKDLVMPKPAPTCNIKATVCSFDDGVDLPPWFPPMVEGAAAEGDDGDDGDDGD

SEQ ID NO: 222 - protein, 56 aa, Human herpesvirus 4
SQDPVHGHTQGPWDPRAPHLPPQWDGSAGHGQDQVSQFPHLQSETGPPRLQLSLVP

SEQ ID NO: 223 - protein, 48 aa, Human herpesvirus 4
PRTPEWPVQGEGGQNVTGPETRRVVVSAVVHMCQDDEFPDLQDPPDEA

SEQ ID NO: 224 - protein, 56 aa, Human herpesvirus 4
TRLQPATPRRSGAADPADPVGHPAAPRAPGPEPRTRLQPATPRRSGAADPADPVGH

SEQ ID NO: 225 - protein, 56 aa, Human herpesvirus 4
PPSPQSPLLEKVAPGRPRDWLSPTSSPRDVTVTPGLAAPITLPGPRLMARPYFGAE

SEQ ID NO: 226 - protein, 56 aa, Human herpesvirus 4
AAKPWLRAHPVAIPYDDPLTNEEIDLAYARGQAMNIEAPRLPDDPIIVEDDDESEE

SEQ ID NO: 227 - protein, 56 aa, Human herpesvirus 4
ATEAGTGTSTGVTSNVTTRSSSTTSATTRITNATTLAPTLSSKGTSNATKTTAELP

SEQ ID NO: 228 - protein, 41 aa, Human herpesvirus 4
VDLPPWFPPMVEGAAAEGDDGDDGDDGDEGGDGDEGEEGQE

SEQ ID NO: 229 - protein, 56 aa, Human herpesvirus 4
VKNLTELTTPTSSPPSSPSPPAPPAARGSTSAAVLRRRRRDAGNATTPVPPAAPGK

SEQ ID NO: 230 - protein, 56 aa, Human herpesvirus 4
VRQSRGDRGLILPQGPQTAPQARLVQPHVPPLRPTAPTILSPLSQPRLTPPQPLMM

SEQ ID NO: 231 - protein, 56 aa, Human herpesvirus 4
DQLLPAPGPDPLEIQPLTSPTTSQLSSSAPSCAQTPWPVVQPSQTPDDPTKQSRPP

SEQ ID NO: 232 - protein, 56 aa, Human herpesvirus 4
LHQPPPVPKPVPVKPTPPPSRRRRGACVVYDDDVIEVIDVETTEDSSSVSQPNKPH

SEQ ID NO: 233 - protein, 56 aa, Human herpesvirus 4
PSRSFTSDSFPAARYSPAKTNSPPPSPASAAPASAAPASAAPASAAPASAAQASVA

SEQ ID NO: 234 - protein, 56 aa, Human herpesvirus 4
PAAPRAPGPEPRTRLQPATPRRSGAADPADPVGHPAAPRAPGPEPRTRLQPATPRR

SEQ ID NO: 235 - protein, 56 aa, Human herpesvirus 4
APQPGDNSTVQPAAAVVFACPGANQGQQLADIGAPQPAPAAAPARRTRKPLQPESL

SEQ ID NO: 236 - protein, 56 aa, Human herpesvirus 4
TIGNFKPYYPWNAPPNENPYHARRGIKEHVIQNAFRKAQIQGLSMLATGGEPRGDA

SEQ ID NO: 237 - protein, 56 aa, Human herpesvirus 4
PWQPLSWPHETRVILHGPPTQGDQAHGSMLDLLEKDDQHMEQQVMATLLPPEPHQP

SEQ ID NO: 238 - protein, 56 aa, Human herpesvirus 4
TGGVKSGRPSLKFKAALERQAAAGLRPSPGSGTGAKIVQAPVFYPPVLQPIQVMWQ

SEQ ID NO: 239 - protein, 56 aa, Human herpesvirus 4
LQPATPRRSGAADPADPVGHPAAPRAPGPEPRTRLQPATPRRSGAADPADPVGHPA

SEQ ID NO: 240 - protein, 56 aa, Human herpesvirus 4; identical to SEQ ID NO: 226

SEQ ID NO: 241 - protein, 56 aa, Human herpesvirus 4
PQDPDNTDDNGPQDPDNTDDNGPQDPDNTDDNGPQDPDNTDDNGPQDPDNTDDNGP

SEQ ID NO: 242 - protein, 49 aa, Human herpesvirus 4
LQHYREVASAKSSENDRLRLLLKQMCPSLDVDSIIPRTPDVLHEDLLNF

SEQ ID NO: 243 - protein, 56 aa, Human herpesvirus 4
APRAPGPEPRTRLQPATPRRSGAADPADPVGHPAAPRAPGPEPRTRLQPATPRRSG

SEQ ID NO: 244 - protein, 40 aa, Human herpesvirus 4
SNTALERPLAVQLARKRTSSEARQKQKHPKKVKQAFNPLI

SEQ ID NO: 245 - protein, 56 aa, Human herpesvirus 4; identical to SEQ ID NO: 234

SEQ ID NO: 246 - protein, 56 aa, Human herpesvirus 4
GIGPEGPLGQLLRRHRSPSPTRGGQEPRRVRRRVLVQQEEEVVSGSPSGPRGDRSE

SEQ ID NO: 247 - protein, 56 aa, Human herpesvirus 4
RTEGEHVEGATGETREESEDTESDGDDEDLPCIVSRGGPKVKRPPIFIRRLHRLLL

SEQ ID NO: 248 - protein, 56 aa, Human herpesvirus 4; identical to SEQ ID NO: 211

SEQ ID NO: 249 - protein, 56 aa, Human herpesvirus 4
HPVGPTPHQTPQVEITPYKPTWAQIGHIPYQPTPTGPATMLLRQWAPATMQTPPRA

SEQ ID NO: 250 - protein, 56 aa, Human herpesvirus 4
MARRLPKPTLQGRLEADFPDSPLLPKFQELNQNNLPNDVFREAQRSYLVFLTSQFC

SEQ ID NO: 251 - protein, 56 aa, Human herpesvirus 4
TPMQLALRAPAGQQGPTKQILRQLLTGGVKKGRPSLKLQAALERQAAAGWQPSPGS

SEQ ID NO: 252 - protein, 56 aa, Human herpesvirus 4
QAWRLEAEGFKPATEEQLEAFLDTAPNKELKRQYEKKLRQLMETGRKEKEKLREQE

SEQ ID NO: 253 - protein, 56 aa, Human herpesvirus 4
TPLPPVSPGDQLPGVFSDGRVACAPVPAPAGPIVRPWEPSLTQAAGQAFAPVRPQH

SEQ ID NO: 254 - protein, 56 aa, Human herpesvirus 4
APSHAQTPWPVTHPSQTPGGPTTQSLAPETEAPRQWPMPLRPIPLHPLRMQPISFN

SEQ ID NO: 255 - protein, 56 aa, Human herpesvirus 4; identical to SEQ ID NO: 224

SEQ ID NO: 256 - protein, 56 aa, Human herpesvirus 4
RGDRSEGPGPTRPGPPGIGPEGPLGQLLRRHRSPSPTRGGQEPRRVRRRVLVQQEE

SEQ ID NO: 257 - protein, 56 aa, Human herpesvirus 4; identical to SEQ ID NO: 184

SEQ ID NO: 258 - protein, 56 aa, Human herpesvirus 4
AADPADPVGHPAAPRAPGPEPRTRLQPATPRRSGAADPADPVGHPAAPRAPGPEPR

SEQ ID NO: 259 - protein, 56 aa, Human herpesvirus 4
VFYNIPPMPLPPSQLPPPAAPAQPPPGVINDQQLHHLPSGPPWWPPICDPPQPSKT

SEQ ID NO: 260 - protein, 56 aa, Human herpesvirus 4
AVSDTNTDCDMDPMEGSEEHSTDGEISSSEEEDEDPTPAHTIPARPSSVVITPTSA

SEQ ID NO: 261 - protein, 56 aa, Human herpesvirus 4
LLEKDDEVMEQRVMATLLPPVPQQPRAGRRGPCVFTGDLGIESDEPASTEPVHDQL

SEQ ID NO: 262 - protein, 56 aa, Human herpesvirus 4
TEGEHGEGATCETREESEDTESDGDDEELPRVVSRDGTKHRRPPIFLRRLHRLLLM

SEQ ID NO: 263 - protein, 56 aa, Human herpesvirus 4
HPLHQQHSMAPCMVAQNPRAPLGDQLPGVPKDGRGACAPVPALAGPIVRPWESSLL

SEQ ID NO: 264 - protein, 56 aa, Human herpesvirus 4
PRTRLQPATPRRSGAADPADPVGHPAAPRAPGPEPRTRLQPATPRRSGAADPADPV

SEQ ID NO: 265 - protein, 56 aa, Human herpesvirus 4
PTPLLTVLQRPTELQPTPSPPRMHLPVLHVPDQSMHPLTHQSTPNDPDSPEPRSPT

SEQ ID NO: 266 - protein, 56 aa, Human herpesvirus 4
SKPHRKPQDGFQRSGRRQKRAMPPPVSPSDAGPPSTRPRVMAPPSTGPRVMATPST

SEQ ID NO: 267 - protein, 56 aa, Human herpesvirus 4
DVTVTPGLAAPITLPGPRLMARPYFGAETRASESPDRSPGTSPRPWPKDSLELLPQ

SEQ ID NO: 268 - protein, 56 aa, Human herpesvirus 4
LESENKALKQQVLRGGACASSTSVPSAPVPPPEPLTARQREVMITQATGRLASQAM

SEQ ID NO: 269 - protein, 56 aa, Human herpesvirus 4
MLDLLEKDDQHMEQQVMATLLPPEPHQPRSGRRAPCVYTADLDIESDEPATSEPVL

SEQ ID NO: 270 - protein, 56 aa, Human herpesvirus 4; identical to SEQ ID NO: 213

SEQ ID NO: 271 - protein, 56 aa, Human herpesvirus 4
SVIKAIEEEHRKKKAARTEQPRATPESQAPTVVLQRPPTQQEPGPVGPLSVQARLE

SEQ ID NO: 272 - protein, 56 aa, Human herpesvirus 4
WPTPKTHPVKRTIVKTSYRSDEAEEAQSTPERPGPSKQPSEPVEPAHTTPAGRSTV

SEQ ID NO: 273 - protein, 56 aa, Human herpesvirus 4
DLSLHPDTATLPPTQDLYPGREDLQATQAPYPGYEEPRPPQAPFVGDYGFVQIPSA

SEQ ID NO: 274 - protein, 56 aa, Human herpesvirus 4
LLRRHRSPSPTRGGQEPRRVRRRVLVQQEEEVVSGSPSGPRGDRSEVPGPARPGPP

SEQ ID NO: 275 - protein, 56 aa, Human herpesvirus 4
RITNATTLAPTLSSKGTSNATKTTAELPTVPDERQPSLSYGLPLWTLVFVGLTFLM

SEQ ID NO: 276 - protein, 33 aa, Human herpesvirus 4
DLDLSDSDHEGDEGGGAVGGGRSLHSLYSLSVI

SEQ ID NO: 277 - protein, 25 aa, Human herpesvirus 4
RGDRSEGPGPTRPGPPGIGPEVSGL

SEQ ID NO: 278 - protein, 56 aa, Human herpesvirus 4
LPAPGPDPLEIQPLTSPNTSQLSSSAPSCAQTPWPVVQPSQTPDDPTKQSRPPETA

SEQ ID NO: 279 - protein, 56 aa, Human herpesvirus 4
ADPVGHPAAPRAPGPEPRTRLQPATPRRSGAADPADPVGHPAAPRAPGPEPRTRLQ

SEQ ID NO: 280 - protein, 56 aa, Human herpesvirus 4
DPADPVGHPAAPRAPGPEPRTRLQPATPRRSGAADPADPVGHPAAPRAPGPEPRTR

SEQ ID NO: 281 - protein, 56 aa, Human herpesvirus 4
RAPGPEPRTRLQPATPRRSGAADPADPVGHPAAPRAPGPEPRTRLQPATPRRSGAA

SEQ ID NO: 282 - protein, 56 aa, Human herpesvirus 4; identical to SEQ ID NO: 243

SEQ ID NO: 283 - protein, 56 aa, Human herpesvirus 4
NRVGADSIMLTATFGCQNAARTLNTFSATVWTPPHAGPREQERYAREAEVRFLRGK

SEQ ID NO: 284 - protein, 29 aa, Human herpesvirus 4
PRVRGGGRVSAAAITWVPKPNVEVWPVDP

SEQ ID NO: 285 - protein, 56 aa, Human herpesvirus 4
VRGRGGWDLDNFSEAETEDEASYAPWRDKDSWSESEAAPWKKELVRHPIRRHRTRE

SEQ ID NO: 286 - protein, 31 aa, Human herpesvirus 4
SWDYIFETTESPSSDEDYVEGPSKRPRPSIQ

SEQ ID NO: 287 - protein, 56 aa, Human herpesvirus 4
SEGDWENVLIEISDSSSEEEAEDAHLDSSQRGKKRKRVDDDAGGSAPAQHVPPPQL

SEQ ID NO: 288 - protein, 56 aa, Human herpesvirus 4
APQPGDNSTVQPAAAVVFACPGANQGQQLADIGAPQPAPAAAPARRTRKPLQPESV

SEQ ID NO: 289 - protein, 56 aa, Human herpesvirus 4
TTPRTRYNATTYLPPSTSSELRPRWTFTSPPVTTAQATVPVPPTSQPRFSNLSMLV

SEQ ID NO: 290 - protein, 56 aa, Human herpesvirus 4
GPRGDRSEVPGPARPGPPGIGPEGPLGQLLRRHRSPSPTRGGQEPRRVRRRVLVQQ

SEQ ID NO: 291 - protein, 56 aa, Human herpesvirus 4
ISHLSSMSPTQPISHEEQPRYEDPDTPLDLSLHPDTATLPPTQDLYPGREDLQATQ

SEQ ID NO: 292 - protein, 56 aa, Human herpesvirus 4
APAGGYFTSPGGYYAGPAGGDPGAFLAMDAHTYHPHPHPPPAYFGLPGLFGPPPPV

SEQ ID NO: 293 - protein, 56 aa, Human herpesvirus 4
DLSIHGRPRPRTPEWPVQGESGQNVTDHEPRRVVVSAIVHMCQDDEFPDLQDPPDE

SEQ ID NO: 294 - protein, 56 aa, Human herpesvirus 4; identical to SEQ ID NO: 280

SEQ ID NO: 295 - protein, 56 aa, Human herpesvirus 4
GPRGQGDGGRRKKGGWYGKHRGEGGSSQKFENIAEGLRLLLARCHVERTTEDGNWV

SEQ ID NO: 296 - protein, 56 aa, Human herpesvirus 4; identical to SEQ ID NO: 239

SEQ ID NO: 297 - protein, 56 aa, Human herpesvirus 4
TPRRSGAADPADPVGHPAAPRAPGPEPRTRLQPATPRRSGAADPADPVGHPAAPRA

SEQ ID NO: 298 - protein, 56 aa, Human herpesvirus 4
NLGAHGGGTDSDPQDPDNTDDNGPQDPDNTDDNGPQDPDNTDDNGPQDPDNTDDNG

SEQ ID NO: 299 - protein, 56 aa, Human herpesvirus 4
DRFGRDHALFETQFTSARGALESLRRARETFESKQLISTYQRVVTATKTQFPKINY

SEQ ID NO: 300 - protein, 56 aa, Human herpesvirus 4
PATPRRSGAADPADPVGHPAAPRAPGPEPRTRLQPATPRRSGAADPADPVGHPAAP

SEQ ID NO: 301 - protein, 56 aa, Human herpesvirus 4
MPTFYLALHGGQTYHLIVDTDSLGNPSLSVIPSNPYQEQLSDTPLIPLTIFVGENT

SEQ ID NO: 302 - protein, 56 aa, Human herpesvirus 4
WTPRSQHPCYRHPWAPWSQDPVHGHTQGPWDPRAPHLPPQWDGSAGHGQDQVSQFP

SEQ ID NO: 303 - protein, 56 aa, Human herpesvirus 4
LRVRRVGKLVELLEKQSLQDQAKVAKVAPLKEFPASTISHPDSGALMIVDSAACEL

SEQ ID NO: 304 - protein, 56 aa, Human herpesvirus 4
DEDEEIDLEEEYPSDEDPSEGSDSDPSWHPSDSDESDYSESDEDEATPGSQASRSS

SEQ ID NO: 305 - protein, 56 aa, Human herpesvirus 4
GEGPSTGPRGQGDGGRRKKGGWFGKHRGHGGSNQKFENIAEGLRTLLARCHVERTT

SEQ ID NO: 306 - protein, 56 aa, Human herpesvirus 4
PWDPRAPHLPPQWDGSAGHGQDQVSQFPHLQSETGPPRLQLSSVPLVSSSAPSWSS

SEQ ID NO: 307 - protein, 56 aa, Human herpesvirus 4
GPEGPLGQLLRRHRSPSPTRGGQEPRRVRRRVLVQQEEEVVSGSPSGPRGDRSEVP

SEQ ID NO: 308 - protein, 56 aa, Human herpesvirus 4
VYDDDVIEVIDVETTEDSSSVSQPNKPHRKHQDGFQRSGRRQKRAAPPTVSPSDTG

SEQ ID NO: 309 - protein, 56 aa, Human herpesvirus 4
PRRPGPDTSSPSMPQLSPVVSLHQGQGPENSPTPGPSTAGPVCRVTPSATPDISPI

SEQ ID NO: 310 - protein, 45 aa, Human herpesvirus 4
QRAAGPSVASRALQAARDRFPGLRRRRYHDPETAAALLGEAETEF

SEQ ID NO: 311 - protein, 56 aa, Human herpesvirus 4
HENFYAEIDDFAPSVLTPTGSDSGAGEEDDDGLYQVPTHWPPLMAPTGLSGERVPC

SEQ ID NO: 312 - protein, 56 aa, Human herpesvirus 4
PTPTGPATMLLRQWAPATMKIPPRAPTPMSPPEVPPVPRQRPRGAPTPTPPPQVLP

SEQ ID NO: 313 - protein, 56 aa, Human herpesvirus 4
PSLKLQAALERQAAAGWQPSPGSGTSDKIVQAPIFYPPVLQPIQVMGQGGSPTAMA

SEQ ID NO: 314 - protein, 56 aa, Human herpesvirus 4
AQPPAPAHQKPTAPTPKPRSRECGPSKTPDPFSWFRKTSCTEGGADSTSRSFMYQK

SEQ ID NO: 315 - protein, 56 aa, Human herpesvirus 4
GPTPHQTPQVEITPYKPTWAQIGHIPYQPTPTGPATMLLRQWAPATMKIPPRAPTP

SEQ ID NO: 316 - protein, 56 aa, Human herpesvirus 4
RKHQDGFQRSGRRQKRAAPPTVSPSDTGPPAVGPPAAGPPAAGPPAAGPPAAGPPA

SEQ ID NO: 317 - protein, 56 aa, Human herpesvirus 4
NLGAPGGGPDNGPQDPDNTDDNGPQDPDNTDDNGPQDPDNTDDNGPQGPDNTDDNG

SEQ ID NO: 318 - protein, 56 aa, Human herpesvirus 4
DAHTYHPHPHPPPAYFGLPGLFGPPPPVPPYYGSHLRADYVPAPSRSNKRKRDPEE

SEQ ID NO: 319 - protein, 56 aa, Human herpesvirus 4
SIIKVIEDEHRKKKTARTEQPRAKPDSPAPTVVLRRPPTQKVTGPAGSLSVQAQLE

SEQ ID NO: 320 - protein, 56 aa, Human herpesvirus 4
PGSGTGAKIVQAPVFYPPVLQPIQVMWQVGSSKAVAASTVTQAPTEYTGERRLGGP

SEQ ID NO: 321 - protein, 56 aa, Human herpesvirus 4
EFSKLSKHAAQLKRLSGSVMNVLNLDDAQDTRQAKAQRKESTRVPIVTHLTNHVPV

SEQ ID NO: 322 - protein, 56 aa, Human herpesvirus 4
APTVVLRRPPTQKVTGPAGSLSVQAQLEPWQPLSWPHETRVILHGPPTQGDQAHGS

SEQ ID NO: 323 - protein, 56 aa, Human herpesvirus 4
SGAADPADPVGHPAAPRAPGPEPRTRLQPATPRRSGAADPADPVGHPAAPRAPGPE

SEQ ID NO: 324 - protein, 56 aa, Human herpesvirus 4
RRGPCVFTGDLGIESDEPASTEPVHDQLLPAPGPDPLEIQPLTSPNTSQLSSSAPS

SEQ ID NO: 325 - protein, 56 aa, Human herpesvirus 4; identical to SEQ ID NO: 297

SEQ ID NO: 326 - protein, 56 aa, Human herpesvirus 4
DEEGGGLFPGEDATLYRKDIAGLSKSVNELQHTLQALRRETLSYGHTGVGYCPQQG

SEQ ID NO: 327 - protein, 56 aa, Human herpesvirus 4
PSRSFTSDSFPAARYSPAKTNSPPSSPASAAPASAAPASAAPASAAPASAAPASAA

SEQ ID NO: 328 - protein, 56 aa, Human herpesvirus 4
PSARPRIMAPPVVRMFMRERQLPQSTGRKPQCFWEMRAGREITQMQQEPSSHLQSA

SEQ ID NO: 329 - protein, 56 aa, Human herpesvirus 4
SDRLQQLGGGETDQGEEGSTTAESEASGPPSPQSPLLEKVAPGRPRDWLSPTSSPR

SEQ ID NO: 330 - protein, 56 aa, Human herpesvirus 4
DPDNTDDNGPQDPDNTDDNGPQDPDNTDDNGPQDPDNTDDNGPQDPDNTDDNGPHD

SEQ ID NO: 331 - protein, 56 aa, Human herpesvirus 4
NTDDNGPHDPLPQDPDNTDDNGPHDPNLPQDPDNTDDNGPQDPDNTDDNGPHDPLP

SEQ ID NO: 332 - protein, 56 aa, Human herpesvirus 4
RKHQDGFQRSGRRQKRAAPPTVSPSDTGPPAAGPPAAGPPAAGPHILTPPSARPRI

SEQ ID NO: 333 - protein, 56 aa, Human herpesvirus 4
QDPDNTDDNGPQDPDNTDDNGPQDPDNTDDNGPQDPDNTDDNGPQDPDNTDDNGPH

SEQ ID NO: 334 - protein, 56 aa, Human herpesvirus 4
HPSDSDESDYSESDEDEATPGSQASRSSRVSPSTQQSSGLTPTPSFSRPRTRAPPR

SEQ ID NO: 335 - protein, 56 aa, Human herpesvirus 4
FCSQNLGAPGGGPDNGPQDPDNTDDNGPQDPDNTDDNGPQDPDNTDDNGPHDPDNT

SEQ ID NO: 336 - protein, 56 aa, Human herpesvirus 4
HVIQNAFRKAQIQGLSMLATGGEPRGDATSETSSDEDTGRQGSDVELESSDDELPY

SEQ ID NO: 337 - protein, 56 aa, Human herpesvirus 4
LCSKNLGAPGGGPNNGPQDPDNTDDNGPQDPDNTDDNGPQDPDNTDDNGPHDPQPH

SEQ ID NO: 338 - protein, 56 aa, Human herpesvirus 4
NTDDNGPQDPDNTDDNGPQDPDNTDDNGPQDPDNTDDNGPHDPLPHNPSDFAGNDG

SEQ ID NO: 339 - protein, 56 aa, Human herpesvirus 4
RRSGAADPADPVGHPAAPRAPGPEPRTRLQPATPRRSGAADPADPVGHPAAPRAPG

SEQ ID NO: 340 - protein, 56 aa, Human herpesvirus 4
PQDPDNTDDNGPQDPDNTDDNGPQDPDNTDDNGPQDPDNTDDNGPHDPLPHNPSDS

SEQ ID NO: 341 - protein, 56 aa, Human herpesvirus 4
PERGSGPADPPAAARLPPERQEPRLPQDLAAAQRCPAGPPPTRSGAAAQRTHRRPP

SEQ ID NO: 342 - protein, 56 aa, Human herpesvirus 4
PPTQQQPPQSAAPAPSPLLPQQQPPPSAARAPSPLPPQQQPLPSATPAPPHAQQLP

SEQ ID NO: 343 - protein, 56 aa, Human herpesvirus 4
PPAVGPPAAGPPAAGPPAAGPPAAGPPAAGPPAAGPRILAPLSAGPPAAGPHIVTP

SEQ ID NO: 344 - protein, 56 aa, Human herpesvirus 4
PPPSAAPAPSPLLPQQQPPPSAARAPSPLPPQQQPLPSATPAPPPAQQLPPSATTL

SEQ ID NO: 345 - protein, 56 aa, Human herpesvirus 4
PCYTHPGPYGFQPHQSYEVPRYVPHPPPPPTSHQAAQAQPPPPGTQAPEAHCVAES

SEQ ID NO: 346 - protein, 56 aa, Human herpesvirus 4
TPERPGPSKQPSEPVEPAHTTPAGRSTVILHEPPREPEAVSFKPPPPPSRRRRGAC

SEQ ID NO: 347 - protein, 56 aa, Human herpesvirus 4
ILHEPPREPEAVSFKPPPPPSRRRRGACVVYDDDIIEVIDVETTEEETTSMQRQPP

SEQ ID NO: 348 - protein, 56 aa, Human herpesvirus 4
MLDLLEKDDEVMEQRVMATLLPPVPQQPRAGRRGPCVFTGDLGIESDEPASTEPVH

SEQ ID NO: 349 - protein, 56 aa, Human herpesvirus 4
PPVMSTQRRDPYVISGASGSYNETDFLGNFLNFIDKEDDGQRPDDEPRYTYWQLNQ

SEQ ID NO: 350 - protein, 56 aa, Human herpesvirus 4
NFLNFIDKEDDGQRPDDEPRYTYWQLNQNLLERLSRLGIDAEGKLEKEPHGPRDFV

SEQ ID NO: 351 - protein, 56 aa, Human herpesvirus 4
AQARQASVEVQPTQLTQVSPQQPMERPLEPEQQMFPGSPFSQVADVARESGVPAMQ

SEQ ID NO: 352 - protein, 56 aa, Human herpesvirus 4
VPKDGRGACAPVPALAGPIVRPWESSLLQSPGRAFAPVSPQPMPVEPVPVPTVALE

SEQ ID NO: 353 - protein, 56 aa, Human herpesvirus 4
NTDDNGPQDPDNTDDNGPQDPDNTDDNGPQDPDNTDDNGPQDPDNTDDNGPQDPDN

SEQ ID NO: 354 - protein, 56 aa, Human herpesvirus 4
NLGAPGGGPDNGPQDPDNTDDNGPQDPDNTDDNGPQDPDNTDDNGPQDPDNTDDNG

SEQ ID NO: 355 - protein, 56 aa, Human herpesvirus 4; identical to SEQ ID NO: 283

SEQ ID NO: 356 - protein, 56 aa, Human herpesvirus 4
AYQAYAAPQLFPVSDITQNQQTNQAGGEAPQPGDNSTVQPAAAVVFACPGANQGQQ

SEQ ID NO: 357 - protein, 56 aa, Human herpesvirus 4
PQDPDNTDDNGPQDPDNTDDNGPHDPLPQDPDNTDDNGPQDPDNTDDNGPHDPLPH

SEQ ID NO: 358 - protein, 56 aa, Human herpesvirus 4
MSDEGPGTGPGNGLGEKGDTSGPEGSGGSGPQRRGGDNHGRGRGRGRGRGGGRPGA

SEQ ID NO: 359 - protein, 56 aa, Human herpesvirus 4; identical to SEQ ID NO: 308

SEQ ID NO: 360 - protein, 56 aa, Human herpesvirus 4
ELQHTLQALRRETLSYGHTGVGYCPQQGPCYTHPGPYGFQPHQSYEVPRYVPHPPP

SEQ ID NO: 361 - protein, 56 aa, Human herpesvirus 4
LVSSSAPSWSSPQPRAPIRPIPTRFPPPPMPLQDSMAVGCDSSGTACPSMPFASDY

SEQ ID NO: 362 - protein, 56 aa, Human herpesvirus 4
TTGQTVEMSPFYDGKNKETFHERADSFHVRTNYKIVDYDNRGTNPQGERRAFLDKG

SEQ ID NO: 363 - protein, 56 aa, Human herpesvirus 4
PPKNATSPQAPSGQKTAVPTVTSTGGKANSTTGGKHTTGHGARTSTEPTTDYGGDS

SEQ ID NO: 364 - protein, 56 aa, Human herpesvirus 4
AQNSMDGMEELRLALATLDPKRVAGGKETVADWKRRLSRLEAIIQEAQEESQLQGT

SEQ ID NO: 365 - protein, 56 aa, Human herpesvirus 4
QDTRQAKAQRKESTRVPIVTHLTNHVPVIKPACSLFLEGAPGVGKTTMLNHLKAVF

SEQ ID NO: 366 - protein, 56 aa, Human herpesvirus 4
PPVCPIVSLTASGAKQNRGGMGSLHLAKPEETSPAVSPVCPIASPAASRSKQHCGV

SEQ ID NO: 367 - protein, 56 aa, Human herpesvirus 4
RSGPDPARRLVALLRREDGAPKDPPLGPFGHPRGPGPAKSEDEESERRDAPPPPLD

SEQ ID NO: 368 - protein, 56 aa, Human herpesvirus 4
PMPLQDSMAVGCDSSGTACPSMPFASDYSQGAFTPLDINATTPKRPRVEESSHGPA

SEQ ID NO: 369 - protein, 56 aa, Human herpesvirus 4
LEVEGMAQNSMDGMEELRLALATLDPKRVAGGKETVADWKRRLSRLEAIIQEAQEE

SEQ ID NO: 370 - protein, 56 aa, Human herpesvirus 4
IEAESDEEEDKSGMESLKNIPQTLPYNPTVYGRPAVFNRKSDAKSTKKCRAIVTDF

SEQ ID NO: 371 - protein, 56 aa, Human herpesvirus 4
RAGRRGPCVFTGDLGIESDEPASTEPVHDQLLPAPGPDPLEIQPLTSPTTSQLSSS

SEQ ID NO: 372 - protein, 56 aa, Human herpesvirus 4
QSSSYPGYAGPWTPRSQHPCYRHPWAPWSQDPVHGHTQGPWDPRAPHLPPQWDGSA

SEQ ID NO: 373 - protein, 56 aa, Human herpesvirus 4; identical to SEQ ID NO: 258

SEQ ID NO: 374 - protein, 56 aa, Human herpesvirus 4
AGPPAAGPRILAPLSAGPPAAGPHIVTPPSARPRIMAPPVVRMFMRERQLPQSTGR

SEQ ID NO: 375 - protein, 56 aa, Human herpesvirus 4
LADIGAPQPAPAAAPARRTRKPLQPESLEECDSELDIKRYKNRVASRKCRAKFKHL

SEQ ID NO: 376 - protein, 36 aa, Human herpesvirus 4
ANCGPAGLLRAHRLPQPKPPCLSRQRPSPDSQTSPC

SEQ ID NO: 377 - protein, 56 aa, Human herpesvirus 4
LGHTPGVPAPSTPPRASGGAAPQTPKRKKGLGKDSPHKKPTSGRRLPLSSTTDTED

SEQ ID NO: 378 - protein, 56 aa, Human herpesvirus 4
EGDYLLTQDEAWNLKDVRKRKLGPGHDLVADSLAANRGVESMLYVMTDPSENAGRI

SEQ ID NO: 379 - protein, 56 aa, Human herpesvirus 4
LCSQNLGAPGGGPDNGPQDPDNTDDNGPQDPDNTDDNGPHDPLPQDPDNTDDNGPQ

SEQ ID NO: 380 - protein, 56 aa, Human herpesvirus 4
TDDNGPQDPDNTDDNGPQDPDNTDDNGPQDPDNTDDNGPQDPDNTDDNGPHDPLPH

SEQ ID NO: 381 - protein, 56 aa, Human herpesvirus 4
RRHRSPSPTRGGQEPRRVRRRVLVQQEEEVVSGSPSGPRGDRSEVPGPARPGPPGI

SEQ ID NO: 382 - protein, 56 aa, Human herpesvirus 4
MKRVARGPCLAPGSGLGAHPHPRRSGAADPADPVGHPAAPRAPGPEPRTRLQPATP

SEQ ID NO: 383 - protein, 56 aa, Human herpesvirus 4
VQPPQLTQVSPQQPMEGPLVPEQQMFPGAPFSQVADVVRAPGVPAMQPQYFDLPLI

SEQ ID NO: 384 - protein, 56 aa, Human herpesvirus 4
APYPGYEEPRPPQAPFVGDYGFVQIPSAQWEPHPSQGTYQGHIDPQLPAALDLGPE

SEQ ID NO: 385 - protein, 56 aa, Human herpesvirus 4
LGGGETDQGEEGSTTAESEASGPPSPQSPLLEKVAPGRPRDWLSPTSSPRDVTVTP

SEQ ID NO: 386 - protein, 56 aa, Human herpesvirus 4
AHGGTGAGGGAGAGGAGAGGAGAGGAGAGGAGAGGAGAGGAGAGGAGAGGAGAGGA

SEQ ID NO: 387 - protein, 56 aa, Human herpesvirus 4
AQAPESRGQGHLRVPPRVPGQPEGPRQPGRPQRPVPRPFPGLQSPGCPPEGTLGVP

SEQ ID NO: 388 - protein, 56 aa, Human herpesvirus 4
PNRGQTPCPSNAEEPEQPWIAAVHQESDERPIFPHPSKPTFLPPVKRKKGLRDSRE

SEQ ID NO: 389 - protein, 56 aa, Human herpesvirus 4
PSATPANHDNPEATPPLADTAALTIPVIEKYIANAGSIVGAAKNPTYIRLRDTIQQ

SEQ ID NO: 390 - protein, 56 aa, Human herpesvirus 4
GPPTAMQLSPRALTGQKGPAKHILRQLLTGGVKSGRPSLKFKAALERQAAAGLRPS

SEQ ID NO: 391 - protein, 56 aa, Human herpesvirus 4
RAGKGKERARETLAKAPRRTYGTPRPPVQKPRPEVPQSYETATSHGSAQVPEPPPT

SEQ ID NO: 392 - protein, 56 aa, Human herpesvirus 4
NSTTGGKHTTGHGARTSTEPTTDYGGDSTTPRTRYNATTYLPPSTSSELRPRWTFT

SEQ ID NO: 393 - protein, 54 aa, Human herpesvirus 4
HHDDSLPHPQQATDDSSNQSDSNSNEGRHLLLVSGAGDGPPLCSQNLGAPGGGP

SEQ ID NO: 394 - protein, 54 aa, Human herpesvirus 4
HHDDSLPHPQQATDDSGHESDSNPNEGRHHLLVSGAGDGPPLCSQNLRAPGGGP

SEQ ID NO: 395 - protein, 56 aa, Human herpesvirus 4
HDDSLPHPQQATDDSGHESDSNSNEGRHHLLVTGAGDGPPLCSQNLGAPGGGPDNG

SEQ ID NO: 396 - protein, 50 aa, Human herpesvirus 4
PLMTDGGGGHSHDSGHDGIDPHLPTLLLGTSGSGGDDDDPHGPVQLSYYD

SEQ ID NO: 397 - protein, 56 aa, Human herpesvirus 4
QKKHTIQIPGLVPSQKPSYPPSAPYKPGQSTGGIAPTPSAASLTTFGLQPQDTQAS

SEQ ID NO: 398 - protein, 56 aa, Human herpesvirus 4
GHGQDQVSQFPHLQSETGPPRLQLSLVPLVSSSAPSWSSPQPRAPIRPIPTRFPPP

SEQ ID NO: 399 - protein, 56 aa, Human herpesvirus 4
QDPDNTDDNGPQDPDNTDDNGPHDPDNTDDPGPHDPLPHNPTDSAGNDGGPPNLTE

SEQ ID NO: 400 - protein, 56 aa, Human herpesvirus 4
SWSSPQPRAPIRPIPTRFPPPPMPLQDSMAVGCDSSGTACPSMPFASDYSQGAFTP

SEQ ID NO: 401 - protein, 56 aa, Human herpesvirus 4
MSGGLFYNPFLRPNKGLLKKPDKEYLRLIPKCFQTPGAAGVVDVRGPQPPLCFYQD

SEQ ID NO: 402 - protein, 29 aa, Human herpesvirus 4
EPRRVVVSAIVHMCQDDEFPDLQDPPDEA

SEQ ID NO: 403 - protein, 56 aa, Human herpesvirus 4
QGPDNTDDNGPQGPDNTDDNGPQGPDNTDDNGPQGPDNTDDNGPHDPLPHNPSDSA

SEQ ID NO: 404 - protein, 56 aa, Human herpesvirus 4
GTPPKNATSPQAPSGQKTAVPTVTSTGGKANSTTGGKHTTGHGARTSTEPTTDYGG

SEQ ID NO: 405 - protein, 56 aa, Human herpesvirus 4
KANSTTGGKHTTGHGARTSTEPTTDYGGDSTTPRTRYNATTYLPPSTSSKLRPRWT

SEQ ID NO: 406 - protein, 56 aa, Human herpesvirus 4
MAPPVVRMFMRERQLPQSTGRKPQCFWEMRASREITQMQQEPSSHLQSATQPTMPR

SEQ ID NO: 407 - protein, 56 aa, Human herpesvirus 4
VNKTTILLRPMKTTTVDLGLYARPPEGHGLMLWGSTSRPVTSHVGIIDPGYTGELR

SEQ ID NO: 408 - protein, 56 aa, Human herpesvirus 4
NTDDNGPQDPDNTDDNGPQGPDNTDDNGPQGPDNTDDNGPQGPDNTDDNGPQGPDN

SEQ ID NO: 409 - protein, 56 aa, Human herpesvirus 4
TSAGDLPLDLSVILFNHASEEAAASTASEPEDKSPRVQPLGTGLQQRPRHTVSPSP

SEQ ID NO: 410 - protein, 56 aa, Human herpesvirus 4
MRAGKRTEQGKEVLEKARGSTYGTPRPPVPKPRPEVPQSDETATSHGSAQVPEPPT

SEQ ID NO: 411 - protein, 56 aa, Human herpesvirus 4
TSETSSDEDTGRQGSDVELESSDDELPYIDPNMEPVQQRPVMFVSRVPAKKPRKLP

SEQ ID NO: 412 - protein, 56 aa, Human herpesvirus 4
VPKPRPEVPQSDETATSHGSAQVPEPPTIHLAAQGMAYPLHEQHGMAPCPVAQAPP

SEQ ID NO: 413 - protein, 56 aa, Human herpesvirus 4
PAVRPTPHQPPQVEPTFYQSTWVKPPQQYQPQMGHIPYQPRPTGHSTMLRPQWAPT

SEQ ID NO: 414 - protein, 56 aa, Human herpesvirus 4
PEPNTSSPSMPELSPVLGLHQGQGAGDSPTPGPSNAAPVCRNSHTATPNVSPIHEP

SEQ ID NO: 415 - protein, 56 aa, Human herpesvirus 4
NTDDNGPQDPDNTDDNGPQDPNNTDDNGPQGPDNTDDNGPHDPLPHNPSDSAGNDG

SEQ ID NO: 416 - protein, 36 aa, Human herpesvirus 4
STASQASAGLLLGGGGQGSGGRRKRRLATVLPGLEV

SEQ ID NO: 417 - protein, 56 aa, Human herpesvirus 4
LCSQNLGAPGGGPDNAPQDPDNTDDNGPQGPDNTDDNGPQGPDNTDDNGPQGPDNT

SEQ ID NO: 418 - protein, 56 aa, Human herpesvirus 4
PESRGQGHLRVPPRVPGQPEGPRQPGRPQRPVPRPFPGLQSPGCPPEGTLGVPSPP

SEQ ID NO: 419 - protein, 56 aa, Human herpesvirus 4
EQWMFQGAPPSQGTDVVQHQLDALGYTLHGLNHPGVPVSPAVNQYHLSQAAFGLPI

SEQ ID NO: 420 - protein, 56 aa, Human herpesvirus 4
PEETSPAVSPVCPIASPAASRSKQHCGVTGSSQAAPSSSSVAPVASLSGDLEEEEE

SEQ ID NO: 421 - protein, 56 aa, Human herpesvirus 4; identical to SEQ ID NO: 339

SEQ ID NO: 422 - protein, 56 aa, Human herpesvirus 4
GHPAAPRAPGPEPRTRLQPATPRRSGAADPADPVGHPAAPRAPGPEPRTRLQPATP

SEQ ID NO: 423 - protein, 56 aa, Human herpesvirus 4
NLGAHAGGPDNDPQDPDNTDDNGPQDPDNTDDHGPQGPDNTDDNGPHDPLPHTPSD

SEQ ID NO: 424 - protein, 56 aa, Human herpesvirus 4
EAARDFLEGVWGGPGAAQDNFISVAEPVSTASQASAGLLLGGGGQGSGGRRKRRLA

SEQ ID NO: 425 - protein, 56 aa, Human herpesvirus 4
ERPIFPHPSKPTFLPPVKRKKGLRDSREGMFLPKPEAGSAISDVFEGREVCQPKRI

SEQ ID NO: 426 - protein, 56 aa, Human herpesvirus 4
NLGAHAGGPDNDPQDPDNTDDNGPQDPNNTDDNGPQDPDNTDDNGPQDPNNTDDNG

SEQ ID NO: 427 - protein, 56 aa, Human herpesvirus 4; identical to SEQ ID NO: 411

SEQ ID NO: 428 - protein, 56 aa, Human herpesvirus 4
KGLGKDSPHKKPTSGRRLPLSSTTDTEDDQLPRTHVPPHRPPSAARLPPPVIPIPH

SEQ ID NO: 429 - protein, 56 aa, Human herpesvirus 4
STGPRDMAPTVVHMFTRERLLTQSTGPAPRSFWEMRAGRDAPKIQQEPSSQQQPAT

SEQ ID NO: 430 - protein, 56 aa, Human herpesvirus 4
EDISRLTGAAWRLCSRPLLYDAETGRVQIPLATEEEEEAVVAVKEKSVSSSPRHYS

SEQ ID NO: 431 - protein, 56 aa, Human herpesvirus 4
DNGPQDPDNTDDNGPQDPDNTDDNGPHDPLPHNPSDSAGNDGGPPNLTEEVENKGG

SEQ ID NO: 432 - protein, 56 aa, Human herpesvirus 4
SDTEQSEREEARAEAPRLRAPKSRRTSRPNRGQTPCPSNAEEPEQPWIAAVHQESD

SEQ ID NO: 433 - protein, 56 aa, Human herpesvirus 4
TPAGTTSGASPVTPSPSPWDNGTESKAPDMTSSTSPVTTPTPNATSPTPAVTTPTP

SEQ ID NO: 434 - protein, 56 aa, Human herpesvirus 4
LCSQNLGAPGGGPDNGPQDPDNTDDNAPQDPDNTDDNGPQDPDNTDDNGPHDPLPH

SEQ ID NO: 435 - protein, 56 aa, Human herpesvirus 4
PQDPDNTDDNGPQDPDNTDDNGPQDPDNTDDNGPQDPDNTADNGPHDPLPHNPSDS

SEQ ID NO: 436 - protein, 56 aa, Human herpesvirus 4
DLPCIVSRGGPKVKRPPIFIRRLHRLLLMRAGKRTEQGKEVLEKARGSTYGTPRPP

SEQ ID NO: 437 - protein, 56 aa, Human herpesvirus 4
ADPVGHPAAPRAPGPEPRTRLQPATPRRSGAADPADPVGHPAAPELQGWVLRPKGT

SEQ ID NO: 438 - protein, 56 aa, Human herpesvirus 4
QDPDNTDDNGPHDPLPQDPDNTDDNGPQDPDNTDDNGPHDPLPHSPSDSAGNDGGP

SEQ ID NO: 439 - protein, 56 aa, Human herpesvirus 4
HLLVTGAGDGPPLCSQNLGAPGGGPDNGPQDPDNTDDNGPQDPDNTDDNGPQDPDN

SEQ ID NO: 440 - protein, 49 aa, Human herpesvirus 4
GPHRPTRPVLRGPAPRRPPPPSSPNTYNKHMMETTPPIKGNNNYNWPWL

SEQ ID NO: 441 - protein, 56 aa, Human herpesvirus 4
QDPDNTDDNGPQGPDNTDDNGPQGPDNTDDNGPQGPDNTDDNGPHDPLPHNPSDST

SEQ ID NO: 442 - protein, 15 aa, Human herpesvirus 4
SAGWPWGKSGRQRVG

SEQ ID NO: 443 - protein, 56 aa, Human herpesvirus 4
PQDPDNTDDNGPQDPDNTDDNGPQDPDNTDDNGPHDPLPHNPSDSAGNDGGPPNLT

SEQ ID NO: 444 - protein, 56 aa, Human herpesvirus 4
QGPDNTDDNGPQGPDNTDDNGPQGPDNTDDNGPQGPDNTDDNGPQGPDNTDDNGPH

SEQ ID NO: 445 - protein, 56 aa, Human herpesvirus 4
TPQMEEDKGPINHPQYPGDVGLDVSLPKDLALFPHQTVSVTLTVPPPSIPHHRPTI

SEQ ID NO: 446 - protein, 56 aa, Human herpesvirus 4
SSSYTLGSQASQSIQEEDVSDTDESDYSDEDEEIDLEEEYPSDEDPSEGSDSDPSW

SEQ ID NO: 447 - protein, 56 aa, Human herpesvirus 4
PQGPDNTDDNGPQGPDNTDDNGPQGPDNTDDNGPHDPLPHNPSDSAGNDGGPPQLT

SEQ ID NO: 448 - protein, 56 aa, Human herpesvirus 4
LCSQNLGAPGGGPNNGPQDPDNTDDNGPQDPDNTDDNGPQDPDNTDDNGPQDPDNT

SEQ ID NO: 449 - protein, 56 aa, Human herpesvirus 4
PSSTHVPTNLTAPASTGPTVSTADVTSPTPAGTTSGASPVTPSPSPWDNGTESKAP

SEQ ID NO: 450 - protein, 42 aa, Human herpesvirus 4
ARLPPERQEPRLPQDLAAAQRCPAGPPPTRSGAAAQRTHRRP

SEQ ID NO: 451 - protein, 56 aa, Human herpesvirus 4
AGTPDADSSPPVMLPFERRIIPYNLRPLPSRSFTSDSFPAARYSPAKTNSPPPSPA

SEQ ID NO: 452 - protein, 56 aa, Human herpesvirus 4
VALGHTLQPTPPPRPTLPQPRIPLIIPPRHTNQPATTPPTAPQRLTLGHQLSLPPH

SEQ ID NO: 453 - protein, 56 aa, Human herpesvirus 4
RIVDSPEKAGSTKSDLPAVAAGVEDQPRVPISAAVIKLGNHAVAVESLQKMYNDTQ

SEQ ID NO: 454 - protein, 56 aa, Human herpesvirus 4
HLQSETGPPRLQLSSVPLVSSSAPSWSSPQPRAPIRPIPTRFPPPPMPLQDSMAVG

SEQ ID NO: 455 - protein, 56 aa, Human herpesvirus 4
ETFESKQLISTYQRVVTATKTQFPKINYKQLERVEELREQELEARDELRQALEPFE

SEQ ID NO: 456 - protein, 56 aa, Human herpesvirus 4
NTDDNGPQDPDNTDDNGPQDPDNTDDNGPHDPLPHNPCDSAGNDAGPPNLTEEAEN

SEQ ID NO: 457 - protein, 56 aa, Human herpesvirus 4
PNSTHVPTNLTAPASTGPTVSTADVTSPTPAGTTSGASPVTPSPSPRDNGTESKAP

SEQ ID NO: 458 - protein, 56 aa, Human herpesvirus 4
IEAESDEEEDKSGMESLKNIPQTLPYNPTVYGRPAVFDRKSDAKSTKKCRAIVTDF

SEQ ID NO: 459 - protein, 56 aa, Human herpesvirus 4
LPEGQYHKLRLPVSAYEALAVARYGLVGSLWEVPAVNSALQCLAAAAPCKDVKIYP

SEQ ID NO: 460 - protein, 56 aa, Human herpesvirus 4
TPKRKKGLGKDSPHKKPTSGRRLPLSSTTDTEDDQLPRPPVPPHRPPSAARLPPPV

SEQ ID NO: 461 - protein, 56 aa, Human herpesvirus 4
IVQAPIFYPPVLQPIQVMGQGGSPTAMAASAVTQAPTEYTRERRGVGPMPPTDIPP

SEQ ID NO: 462 - protein, 56 aa, Human herpesvirus 4
MSNGDWGQSQRTRGTGPVRGIRTMDVNAPGGGSGGSALRILGTASCNQAHCKFGRF

SEQ ID NO: 463 - protein, 56 aa, Human herpesvirus 4
PPQFPSPRASGPLRPRPPETRASGPASPVTLLEPQPGHMCQTPWPLRPSGPPGPRP

SEQ ID NO: 464 - protein, 56 aa, Human herpesvirus 4
DDNGPQGPDNTDDNGPQGPDNTDDNGPHGPLPHNPSDSAGNEGGPPELTEEVENKG

SEQ ID NO: 465 - protein, 56 aa, Human herpesvirus 4
PSWVPSVCALSVMDAGKAQPIQSSHLSSMSPTQPISHEEQPRYEDPDAPLDLSLHP

SEQ ID NO: 466 - protein, 56 aa, Human herpesvirus 4
RFLSYLQKLKNNNNDQLRQKEVQAWRLEAEGFKPATEEQLEAFLDTAPNKELKRQY

SEQ ID NO: 467 - protein, 56 aa, Human herpesvirus 4; identical to SEQ ID NO: 444

SEQ ID NO: 468 - protein, 56 aa, Human herpesvirus 4
SETGPPRLQLSSVPQVLYPQPLVSSSAPSWSSPQPRAPIRPIPTRFPPPPMPLQDS

SEQ ID NO: 469 - protein, 56 aa, Human herpesvirus 4
QWEPHPSQGTYQGHIDPQLPAALDLGPEQPRFPQDPYVYSGGQLSSCPGYAGPWPS

SEQ ID NO: 470 - protein, 56 aa, Human herpesvirus 4
PDPFSWFRKTSCTEGGADSTSRSFMYQKGFEEGLAGLGLDDKSDCESEDESNFRRP

SEQ ID NO: 471 - protein, 56 aa, Human herpesvirus 4
QRNGTLLRDPRTYLAGMTNVNGAPGLCHGQQATCEIIVTPVTADVAYFQKSNSPRG

SEQ ID NO: 472 - protein, 56 aa, Human herpesvirus 4
VPPVPRQRPRGAPTPTPPPQVLPTPMQLALRAPAGQQGPTKQILRQLLTGGVKKGR

SEQ ID NO: 473 - protein, 56 aa, Human herpesvirus 4
LGQQPPPPVISTGSAMSSSHTDPSVTQPSKPHRKPQDGFQRSGRRQKRAMPPPVSP

SEQ ID NO: 474 - protein, 34 aa, Human herpesvirus 4
KGGHQGPPPMTDGGGGHSHDSGHDGGDPPLPTLL

SEQ ID NO: 475 - protein, 56 aa, Human herpesvirus 4
NLGAPGGGPNNGPQDPDNTDDNGPQDPDNTDDNSPQGPDNTDDNSPQGPDNTDDNG

SEQ ID NO: 476 - protein, 37 aa, Human herpesvirus 4
CALTLPGNIVVESSSLPTFERINKTFNGNIVASEGTL

SEQ ID NO: 477 - protein, 56 aa, Human herpesvirus 4
HDDSLPHPQQATDDSSHESDSNSNEGRHHLLVSGAGDGPPLCSQNLGAPGGGPDNG

SEQ ID NO: 478 - protein, 56 aa, Human herpesvirus 4
NLGAPGGGPDNGPQDPDNTDDNGPQDPDNTDDNGPHDPLPQDPDNTDDNGPHDPNL

SEQ ID NO: 479 - protein, 56 aa, Human herpesvirus 4
PQDPDNTDDNGPQDPDNTDDNGNTDDNGPQDPDNTDDNGPHDPLPHNPSDSAGNDG

SEQ ID NO: 480 - protein, 56 aa, Human herpesvirus 4
HLLVSGAGDGPPLCSQNLGAPGGGPDNGPQDPDNTDDNGPQDPDNTDDNGNTDDNG

SEQ ID NO: 481 - protein, 56 aa, Human herpesvirus 4
TVYGRPAVFDRKSDAKSTKKCRAIVTDFSVIKAIEEEHRKKKAARTEQPRATPESQ

SEQ ID NO: 482 - protein, 56 aa, Human herpesvirus 4
LCSQNLGAPEGGPDNAPQDPDNTDDNGPQDPDNTDDNGPQDPDNTDDNGPQDPDNT

SEQ ID NO: 483 - protein, 56 aa, Human herpesvirus 4
NLGAPGGGPNNGPQDPDNTDDNGPQDPDNTDDNSPQGPDNTDDNSPQGPDNTDDNS

SEQ ID NO: 484 - protein, 56 aa, Human herpesvirus 4
STSAAVLRRRRRDAGNATTPVPPAAPGKSLGTLNNPATVQIQFAYDSLRRQINRML

SEQ ID NO: 485 - protein, 36 aa, Human herpesvirus 4
HTYPPYLSAAAAASRVRPRTRRGATRRPPRPTAEDE

SEQ ID NO: 486 - protein, 56 aa, Human herpesvirus 4
DDNGPQGPDNTDDNGPHDPLPHNPSDSAGNEGGPPQLTEEVENKGGDRGSPSITDG

SEQ ID NO: 487 - protein, 56 aa, Human herpesvirus 4
LCSQNLGAPGGGPDNGPQGPDNTDDNGPQGPDNTDDNGPQGPDNTDDNGPQGPDNT

SEQ ID NO: 488 - protein, 56 aa, Human herpesvirus 4
MAVGCDSSGTACPSMPFASDYSQGAFTPLDINAPTPKSPRVEESSHGPARCSQATS

SEQ ID NO: 489 - protein, 56 aa, Human herpesvirus 4
DMTSPTSAVTTPTPNATSPTPAVTTPTPNATSPTLGKTSPTSAVTTPTPNATSPTV

SEQ ID NO: 490 - protein, 56 aa, Human herpesvirus 4
NLGAPGGGPDNGPQDPDNTDDNGPQGPDNTDDNGPQGPDNTDDNGPHDPLPHNPSD

SEQ ID NO: 491 - protein, 51 aa, Human herpesvirus 4
SAGNDGGPPELTEEVENKGGDRGPPLKTDGGGAHSHDSGRGGGDPHLPTLL

SEQ ID NO: 492 - protein, 56 aa, Human herpesvirus 4
SKRAKIEAYTEPEMPHGGASHSPVVILENVGQGQQQTLECGGTAKQERDMLGLGDI

SEQ ID NO: 493 - protein, 56 aa, Human herpesvirus 4
DDNGPQDPDNTDDNGPQDPDNTDDNGPHDPQPHNPSDPAGNDGGPPTLTEEVENKQ

SEQ ID NO: 494 - protein, 56 aa, Human herpesvirus 4
NTDDHGPQGPDNTDDNGPHDPLPHTPSDSAGNDGGPPQLTEEVENKQGDQGPPPMT

SEQ ID NO: 495 - protein, 56 aa, Human herpesvirus 4
HLLVSGAGDGPPLCSQNLGAPGGGPDNGPQDPDNTDDNGPQDPDNTDDNGPQDPDN

SEQ ID NO: 496 - protein, 56 aa, Human herpesvirus 4
ASLLPEVSVGHQELSPLRSRSQGGQTDVRSGPDPARRLVALLRREDGAPKDPPLGP

SEQ ID NO: 497 - protein, 56 aa, Human herpesvirus 4
TPAGTTSGASPVTPSPSPRDNGTESKAPDMTSPTSAVTTPTPNATSPTPAVTTPTP

SEQ ID NO: 498 - protein, 56 aa, Human herpesvirus 4
QDPDNTDDNGPQDPDNTDDNGPQDPDNTDDNGPQGPDNTDDNGDNGPHDPLPHNPS

SEQ ID NO: 499 - protein, 56 aa, Human herpesvirus 4
ASAVTQAPTEYTRERRGVGPMPPTDIPPSKRAKIEAYTEPEMPHGGASHSPVVILE

SEQ ID NO: 500 - protein, 56 aa, Human herpesvirus 4
QDPDNTDDNGPQDPDNTDDNGPHDPQPHNPSDPAGNDGGPPTLTEEVENKQGDQDP

SEQ ID NO: 501 - protein, 56 aa, Human herpesvirus 4
PAQKGTKRKRVDHDAGGSAPARPMLPPQPDLPGREAILRRFPLDLRTLLQAIGAAA

SEQ ID NO: 502 - protein, 56 aa, Human herpesvirus 4
TDDNGPQDPDNTDDNGPHDPLPHNPSDSAGNDGGPPNLTEEVDNKGGDRGPPSMTD

SEQ ID NO: 503 - protein, 56 aa, Human herpesvirus 4
PCKRSFIRFINSIARPTVEYVPDGRLPSEGDYLLTQDEAWNLKDVRKRKLGPGHDL

SEQ ID NO: 504 - protein, 56 aa, Human herpesvirus 4
QDPDNTDDNGPQDPDNTDDNGPHDPLPHSPSDSAGNDGGPPQLTEEVENKGGDQGP

SEQ ID NO: 505 - protein, 56 aa, Human herpesvirus 4
LVSGAGDGPPLCSQNLGAPGGGPDNGPQDPDNTDDNGPQDPDNTDDNGPQDPDNTD

SEQ ID NO: 506 - protein, 56 aa, Human herpesvirus 4
VQNVGPVKVGHVVAGHNLHAEVSDELEEGVEHVQLRWELVDLNPLYVFAGAQRQQD

SEQ ID NO: 507 - protein, 56 aa, Human herpesvirus 4
VAGGKETVADWKRRLSRLEAIIQEAQEESQLQGTLQDLVTQARGHTDPRQLKIVVE

SEQ ID NO: 508 - protein, 56 aa, Human herpesvirus 4
SEHPAFSMVESVKRVRVDEGANTRRTIRDILEIPVTVLSSLQLSPTKSILKKAPEP

SEQ ID NO: 509 - protein, 56 aa, Human herpesvirus 4
AEGFKPATEEQLEAFLDTAPNKELKRQYEKKLRQLMETGRKEKEKLREQEDKERRE

SEQ ID NO: 510 - protein, 47 aa, Human herpesvirus 4
VVILENVSRGQQQTLECGGTAKQERDMLGLGDIAVSSPSSSETSNDE

SEQ ID NO: 511 - protein, 56 aa, Human herpesvirus 4
DELQDQASGARPGGGNRVGAGRGRPGTPAPSRQSRRTGPAEQADHAHSNPTGGCSD

SEQ ID NO: 512 - protein, 56 aa, Human herpesvirus 4
GTSDKIVRAPIFYPPVLQPIQVMGQGGSPTAMAASAVTQAPTEYTRERRGVGPMPP

SEQ ID NO: 513 - protein, 30 aa, Human herpesvirus 4
HPHPERGSGPADPPAAARLPPERQEPRLPQ

SEQ ID NO: 514 - protein, 56 aa, Human herpesvirus 4
LESGSSAPTSPITLDTARSQYYQTTFDIETPEMDFVPLESNIARIAGHTYQEQAIV

SEQ ID NO: 515 - protein, 56 aa, Human herpesvirus 4
PPPHQSTPHCSSDSTGLPPPPTSYSIPSMTLSPEPLPPPAAPAHPLPGVIYDQQAL

SEQ ID NO: 516 - protein, 56 aa, Human herpesvirus 4
MLLAFHRNLGASLGGIRLPQVASARASCPPQFPSPRASGPLRPRPPETRASGPASP

SEQ ID NO: 517 - protein, 56 aa, Human herpesvirus 4
HDDSLPHPQQATDDSSNQSDSNSNEGRHLLLVSGAGDGPPLCSQNLGAPGGGPNNG

SEQ ID NO: 518 - protein, 56 aa, Human herpesvirus 4
LLLVSGAGDGPPLCSQNLGAPGGGPNNGPQDPDNTDDNGPQDPDNTDDNGPHDPLP

SEQ ID NO: 519 - protein, 56 aa, Human herpesvirus 4
PGKLKKRFLSYLQKLKNNNNDQLRQKEVQAWRLEAEGFKPATEEQLEAFLDTAPNK

SEQ ID NO: 520 - protein, 56 aa, Human herpesvirus 4
MSPTDIPPSKRVKKKAYPERKTPHGGPSHSSTVMWENVSQGQQQTLECGGTDKQER

SEQ ID NO: 521 - protein, 56 aa, Human herpesvirus 4
LADIGAPQPAPAAAPARRTRKPLQPESVRRGSKRVAANGGAQRGWQRTVGLKEGGS

SEQ ID NO: 522 - protein, 56 aa, Human herpesvirus 4
TPAGTTSGASPVTPSPSPRDNGTESKAPDMTSPTPAVTTPTPNATSPTSAVTTPTP

SEQ ID NO: 523 - protein, 56 aa, Human herpesvirus 4
STYLNKITTVVHGPVVSKAIPRSTVKVTVPQEAFVDLDAWLSGGAGGGGGVCFVGG

SEQ ID NO: 524 - protein, 56 aa, Human herpesvirus 4
HDDSLPHPQQATDDSGHESDSNSNEGRHHLLVSGAGDGPPLCSQNLGAPGGGPDNG

SEQ ID NO: 525 - protein, 56 aa, Human herpesvirus 4
ESDERPIFPHPSKPTFLPPVKRKKGLRDSREGMFLPKPEAGSAISDVFEGREVCQP

SEQ ID NO: 526 - protein, 56 aa, Human herpesvirus 4
EECDSELDIKRYKNRVASRKCRAKFKHLLQHYREVASAKSSENDRLRLLLKQMCPS

SEQ ID NO: 527 - protein, 48 aa, Human herpesvirus 4
MTDGGGGHSHDSGSGGVDPHLPTLLLGASGSGGDDDDPHGPVQLSYYD

SEQ ID NO: 528 - protein, 56 aa, Human herpesvirus 4
LCSQNLRAPGGGPDNGPQDPDNTDDNGPQGPDNTDDNGPQGPDNTDDNGPQGPDNT

SEQ ID NO: 529 - protein, 56 aa, Human herpesvirus 4
SQRGKKRKRVDDDAGGSAPAQHVPPPQLDHPGREAILYRFPLDLRRFIQAIGAAAT

SEQ ID NO: 530 - protein, 56 aa, Human herpesvirus 4
STASGSQKKHTIQIPGLVPSQKPSYPPSAPYKPGQSTGGIAPTPSAASLTTFGLQP

SEQ ID NO: 531 - protein, 56 aa, Human herpesvirus 4
PAPQQPPSSPWASEQGPIVYTLSPNSTPSTASGSQKKHTIQIPGLVPSQKPSYPPS

SEQ ID NO: 532 - protein, 56 aa, Human herpesvirus 4
TRASESPDRSPGTSPRPWPKDSLELLPQPAPQQPPSSPWASEQGPIVYTLSPNSTP

SEQ ID NO: 533 - protein, 56 aa, Human herpesvirus 4; identical to SEQ ID NO: 477

SEQ ID NO: 534 - protein, 56 aa, Human herpesvirus 4
MAHKVTSANEPNPLTGKRLSSCPLTRSGVTEVAQIAGRTPKMEDFVPWTVDNLKSQ

SEQ ID NO: 535 - protein, 56 aa, Human herpesvirus 4
NLLERLSRLGIDAEGKLEKEPHGPRDFVKMFKDVDAAVDAEVVQFMNSMAKNNITY

SEQ ID NO: 536 - protein, 56 aa, Human herpesvirus 4
CLLSTKSKAVETPILVSGADRMDEELMGNDGGASHTEARYSESGQFHAFTDELESL

SEQ ID NO: 537 - protein, 56 aa, Human herpesvirus 4
PSPTMPLKPGAQSADCGDSSSSSSDSGNSDTEQSEREEARAEAPRLRAPKSRRTSR

SEQ ID NO: 538 - protein, 56 aa, Human herpesvirus 4
TIGNFKPYYPWNAPPNENPYHARRGIKEHVIQNAFRKAQIQGLSMLATVGEPRGDA

SEQ ID NO: 539 - protein, 56 aa, Human herpesvirus 4
HTPVGALAPSPQKTQAQRPQDAAALPTPTIKAVGARPVPKATGALAAGARPRGQPT

SEQ ID NO: 540 - protein, 56 aa, Human herpesvirus 4
PAFDPGEAPSGLPIPQAPALGSGLAAPAHTPVGALAPSPQKTQAQRPQDAAALPTP

SEQ ID NO: 541 - protein, 56 aa, Human herpesvirus 4
SQDPPYGHSIMQREKKQQGGREEAAEIRPSATRLPTAVGLRPRAPVVAAGAAASAT

SEQ ID NO: 542 - protein, 56 aa, Human herpesvirus 4
PSSPWASEQGPIVYTLSPHSTPSTASGSQKKHTIQIPGLVPSQKPSYPPSAPYKPG

SEQ ID NO: 543 - protein, 56 aa, Human herpesvirus 4
RPFHPPGSPWANRPLPASLAPTPTGPVHEPVGSLTPAPVPRPLDPAPAVTPEASHL

SEQ ID NO: 544 - protein, 56 aa, Human herpesvirus 4
IHLAAQGMAYPLHEQHGMAPCPVAQAPPTPLPPVSPGDQLPGVFSDGRVACAPVPA

SEQ ID NO: 545 - protein, 56 aa, Human herpesvirus 4
YSESFEPEMSIFARQAVWLRELLTEARAAKPKEARPPTVAILANRKNIIWKCFTYR

SEQ ID NO: 546 - protein, 56 aa, Human herpesvirus 4
TSRPNRGQTPCPSNAAEPEQPWIAAVHQESDERPIFPHPSKPTFLPPVKRKKGLRD

SEQ ID NO: 547 - protein, 56 aa, Human herpesvirus 4
ALAEPVDIPAVSEGSMQVDASKVHPGVISGLNSPACMLSAPLEKQLFYYIGTMLPN

SEQ ID NO: 548 - protein, 56 aa, Human herpesvirus 4
NLLAPGGGPDNGPQDPDNTDDNGPQDPDNTDDNGPQDPDNTDDNGPQDPDNTDDNG

SEQ ID NO: 549 - protein, 56 aa, Human herpesvirus 4
NSPSASLGARVSGHNESILNSFVSQYIPPSREMTKDLTELWESELFNTFKLTPVVD

SEQ ID NO: 550 - protein, 56 aa, Human herpesvirus 4
PSSTHVPTNLTAPASTGPTVSTADVTSPTPAGTTSGASPVTPSPSPRDNGTESKAP

SEQ ID NO: 551 - protein, 56 aa, Human herpesvirus 4
AGVFVYGGSKTSLYNLRRGTALAIPQCRLTPLSRLPFGMAPGPGPQPGPLRESIVC

SEQ ID NO: 552 - protein, 56 aa, Human herpesvirus 4
VSGLGTAPKTLIITRTATNATTTTHKVIFSKAPESTTTSPTLNTTGFADPNTTTGL

SEQ ID NO: 553 - protein, 56 aa, Human herpesvirus 4
PAAPGAPGTPAAPGPGGGAAVPSGATPHPERGSGPADPPAAARLPPERQEPRLPQD

SEQ ID NO: 554 - protein, 56 aa, Human herpesvirus 4; identical to SEQ ID NO: 529

SEQ ID NO: 555 - protein, 56 aa, Human herpesvirus 4
CAQVLKNRLLRVELDGIMRDHLARAEEIRQDLDAVVAFSDGLESMQVRSPSTGGRS

SEQ ID NO: 556 - protein, 44 aa, Human herpesvirus 4
LAAAQRCPAGPPPTRSGAAAQRTHRRPPGCPRSARNPGCPRTWR

SEQ ID NO: 557 - protein, 56 aa, Human herpesvirus 4; identical to SEQ ID NO: 497

SEQ ID NO: 558 - protein, 51 aa, Human herpesvirus 4
TAPAGHRGDVEARVWDGTYAPKAAQQIQGPFQALQPHGVRHAIKHAIDSLH

SEQ ID NO: 559 - protein, 56 aa, Human herpesvirus 4
QDPDNTDDNGPQDPDNTDDNGPHDPLPHNPSDSAGNDGGPPNLTEEVENKGGDRGP

SEQ ID NO: 560 - protein, 56 aa, Human herpesvirus 4
DPDNTDDNGPHDPLPHSPSDSAGNDGGPPQLTEEVQNKGGDQGPPLMTDGGGGHSH

SEQ ID NO: 561 - protein, 56 aa, Human herpesvirus 4
QKPRPEVPQSYETATSHGSAQVPEPPPTHPLHQQHSMAPCMVAQNPRAPLGDQLPG

SEQ ID NO: 562 - protein, 56 aa, Human herpesvirus 4
AAARLPPERQEPRLPQDLAAAQRCPAGPPPTRSGAAAQRTHRRPPGCPRSARNPGC

SEQ ID NO: 563 - protein, 56 aa, Human herpesvirus 4
GTTVTPVPTTSNASTINVTTKVTAQNITATEAGTGTSTGVTSNVTTRSSSTTSATT

SEQ ID NO: 564 - protein, 56 aa, Human herpesvirus 4
LCSQNLGAPGGGPDNGPQDPDNTDDNGPQDPDNTDDNGPQGPDNTDDNGPQGPDNT

SEQ ID NO: 565 - protein, 56 aa, Human herpesvirus 4
SAAPASAAPASAAPASAAPASAAPASAAPASAAPASAAPASAAPASSPPLFIPIPG

SEQ ID NO: 566 - protein, 30 aa, Human adenovirus C; identical to SEQ ID NO: 8

SEQ ID NO: 567 - protein, 56 aa, Human adenovirus C
PPAFPNNGIESLVDKMSRWKTYAQEHRDVPGPRPPTRRQRHDRQRGLVWEDDDSAD

SEQ ID NO: 568 - protein, 56 aa, Human adenovirus C
GGNNSGSGAEENSNAAAAAMQPVEDMNDHAIRGDTFATRAEEKRAEAEAAAEAAAP

SEQ ID NO: 569 - protein, 56 aa, Human adenovirus C; identical to SEQ ID NO: 33

SEQ ID NO: 570 - protein, 56 aa, Human adenovirus C
ELKCLHGSIMINKEHVIEMDVTSENGQRALKEQSSKAKIVKNRWGRNVVQISNTDA

SEQ ID NO: 571 - protein, 53 aa, Human adenovirus C; identical to SEQ ID NO: 40

SEQ ID NO: 572 - protein, 56 aa, Human adenovirus C
MAPKKKLQLPPPPTDEEEYWDSQAEEVLDEEEEDMMEDWESLDEEASEVEEVSDET

SEQ ID NO: 573 - protein, 56 aa, Human adenovirus C
PSPSVAFPSPAPQKSATVPSIATTSAPQAPPALPVRRPNRRWDTTGTRAGKSKQPP

SEQ ID NO: 574 - protein, 56 aa, Human adenovirus C
TRTTRPRLLGEEEYLNNSLLQPQREKNLPPAFPNNGIESLVDKMSRWKTYAQEHRD

SEQ ID NO: 575 - protein, 56 aa, Human adenovirus C
MQRAAMYEEGPPPSYESVVSAAPVAAALGSPFDAPLDPPFVPPRYLRPTGGRNSIR

SEQ ID NO: 576 - protein, 56 aa, Human adenovirus C
ATGVLGQHTPVTLDLPPPADTQQKPVLPGPSAVVVTRPSRASLRRAASGPRSMRPV

SEQ ID NO: 577 - protein, 56 aa, Human adenovirus C
DEEEEDMMEDWESLDEEASEVEEVSDETPSPSVAFPSPAPQKSATGSSMATTSAPQ

SEQ ID NO: 578 - protein, 56 aa, Human adenovirus C
VEEPPPAVETVSPEGRGEKRPRPDREETLVTQIDEPPSYEEALKQGLPTTRPIAPM

SEQ ID NO: 579 - protein, 56 aa, Human adenovirus C
LAPTVQLMVPKRQRLEDVLEKMTVEPGLEPEVRVRPIKQVAPGLGVQTVDVQIPTT

SEQ ID NO: 580 - protein, 56 aa, Human adenovirus C
PSPSVAFPSPAPQKSATGSSMATTSAPQAPPALPVRRPNRRWDTTGTRAAHTAPAA

SEQ ID NO: 581 - protein, 56 aa, Human adenovirus C
LKPVTLQQVLPTLAPSEEKRGLKRESGDLAPTVQLMVPKRQRLEDVLEKMTVEPGL

SEQ ID NO: 582 - protein, 56 aa, Human adenovirus C
MAPKKKLQLPPPPPTDEEEYWDSQAEEVLDEEEETMEDWDSLDEEASEAEEVSDET

SEQ ID NO: 583 - protein, 56 aa, Human adenovirus C
RRLAAGIVTVPPRSRRRAAAAAAAAISAMTQGRRGNVYWVRDSVSGLRVPVRTRPP

SEQ ID NO: 584 - protein, 56 aa, Human adenovirus C
EPEVRVRPIKQVAPGLGVQTVDVQIPTTSSTSIATATEGMETQTSPVASAVADAAV

SEQ ID NO: 585 - protein, 56 aa, Human adenovirus C
SSTSIATATEGMETQTSPVASAVADAAVQAAAAAASKTSTEVQTDPWMFRVSAPRR

SEQ ID NO: 586 - protein, 56 aa, Human adenovirus C
LVTQIDEPPSYEEALKQGLPTTRPIAPMATGVLGQHTPVTLDLPPPADTQQKPVLP

SEQ ID NO: 587 - protein, 22 aa, Human adenovirus C
MKRARPSEDTFNPVYPYDTETG

SEQ ID NO: 588 - protein, 45 aa, Human adenovirus C
PSRASLRRAASGPRSLRPVASGNWQSTLNSIVGLGVQSLKRRRCF

SEQ ID NO: 589 - protein, 56 aa, Human adenovirus C
LDEEEETMEDWDSLDEEASEAEEVSDETPSPSVAFPSPAPQKSATVPSIATTSAPQ

SEQ ID NO: 590 - protein, 56 aa, Human adenovirus C
FKPYSGTAYNALAPKGAPNSCEWEQTEDSGRAVAEDEEEEDEDEEEEEEEQNARDQ

SEQ ID NO: 591 - protein, 56 aa, Human adenovirus C
EPEPARPTRRPKLVPAILRRPTSPVSRECNSSTDSCDSGPSNTPPEIHPVVPLCPI

SEQ ID NO: 592 - protein, 56 aa, Human adenovirus C
PSPTASGGATSAADAAADGDYEPPRRRARHYLDLEEGEGLARLGAPSPERHPRVQL

SEQ ID NO: 593 - protein, 56 aa, Human adenovirus C
MSKEIPTPYMWSYQPQMGLAAGAAQDYSTRINYMSAGPHMISRVNGIRAHRNRILL

SEQ ID NO: 594 - protein, 56 aa, Human adenovirus C
ASGISGVVDLANQAVQNKINSKLDPRPPVEEPPPAVETVSPEGRGEKRPRPDREET

SEQ ID NO: 595 - protein, 56 aa, Human adenovirus C
ADNLPPPSHFEPPTLHELYDLDVTAPEDPNEEAVSQIFPDSVMLAVQEGIDLLTFP

SEQ ID NO: 596 - protein, 56 aa, Human adenovirus C
APPALPVRRPNRRWDTTGTRAAHTAPAAAAAAATAAATQKQRRPDSKTLTKPKKST

SEQ ID NO: 597 - protein, 56 aa, Human adenovirus C
QAAAAAASKTSTEVQTDPWMFRVSAPRRPRRSRKYGTASALLPEYALHPSIAPTPG

SEQ ID NO: 598 - protein, 56 aa, Human adenovirus C
PNLVPEVIDLTCHEAGFPPSDDEDEEGPVSEPEPEPEPEPEPARPTRRPKLVPAIL

SEQ ID NO: 599 - protein, 56 aa, Human adenovirus C
KAWNSSTGQMLRDKLKEQNFQQKVVDGLASGISGVVDLANQAVQNKINSKLDPRPP

SEQ ID NO: 600 - protein, 56 aa, Human adenovirus C
SDQHPVRVRGHYRAPWGAHKRGRTGRTTVDDAIDAVVEEARNYTPTPPPVSTVDAA

SEQ ID NO: 601 - protein, 56 aa, Human adenovirus C
PPGFYTGGFEVPEGNDGFLWDDIDDSVFSPQPQTLLELQQREQAEAALRKESFRRP

SEQ ID NO: 602 - protein, 56 aa, Human adenovirus C; identical to SEQ ID NO: 593

SEQ ID NO: 603 - protein, 56 aa, Human adenovirus C
ALEINLEEEDDDNEDEVDEQAEQQKTHVFGQAPYSGINITKEGIQIGVEGQTPKYA

SEQ ID NO: 604 - protein, 56 aa, Human adenovirus C
ADNLPPPSHFEPPTLHELYDLDVTAPEDPNEEAVSQIFPESVMLAVQEGIDLFTFP

SEQ ID NO: 605 - protein, 56 aa, Human adenovirus C
MERRNPSERGVPAGFSGHASVESGCETQESPATVVFRPPGDNTDGGAAAAAGGSQA

SEQ ID NO: 606 - protein, 56 aa, Human adenovirus C
GNIPALLDVDAYQASLKDDTEQGGDGAGGGNNSGSGAEENSNAAAAAMQPVEDMND

SEQ ID NO: 607 - protein, 56 aa, Human adenovirus C
TSHGMLALKMGSGLTLDKAGNLTSQNVTTVTQPLKKTKSNISLDTSAPLTITSGAL

SEQ ID NO: 608 - protein, 56 aa, Human adenovirus C
APPALPVRRPNRRWDTTGTRAGKSKQPPPLAQEQQQRQGYRSWRGHKNAIVACLQE

SEQ ID NO: 609 - protein, 56 aa, Human adenovirus C
GSPFDAPLDPPFVPPRYLRPTGGRNSIRYSELAPLFDTTRVYLVDNKSTDVASLNY

SEQ ID NO: 610 - protein, 31 aa, Human adenovirus C
YFNPFSGPPGHYPDQFIPNFDAVKDSADGYD

SEQ ID NO: 611 - protein, 56 aa, Human adenovirus C
TPGERSTRTYKRVYDEVYGDEDLLEQANERLGEFAYGKRHKDMLALPLDEGNPTPS

SEQ ID NO: 612 - protein, 56 aa, Human adenovirus C
VSEPEPEPEPEPEPARPTRRPKLVPAILRRPTSPVSIECNSSTDSCDSGPSNTPPE

SEQ ID NO: 613 - protein, 56 aa, Human adenovirus C
PAPGSPEPPHLSRQPEQPEQRALGPVSMPNLVPEVIDLTCHEAGFPPSDDEDEEGP

SEQ ID NO: 614 - protein, 56 aa, Human adenovirus C; identical to SEQ ID NO: 604

SEQ ID NO: 615 - protein, 56 aa, Human adenovirus C
MKRARPSEDTFNPVYPYDTETGPPTVPFLTPPFVSPNGFQESPPGVLSLRLSEPLV

SEQ ID NO: 616 - protein, 56 aa, Human adenovirus C
MERRNPSERGVPAGFSGHAFVESGGETQESPTTVVFRPPGNNTDGGAAAATAAAGG

SEQ ID NO: 617 - protein, 56 aa, Human adenovirus C
TRINYMSAGPHMISRVNGIRAHRNRILLEQAAITTTPRNNLNPRSWPAALVYQESP

SEQ ID NO: 618 - protein, 56 aa, Human adenovirus C
EQEEPTQEMAEELEDEEEAEEEEEAEEEAEAPQADQKVKKTHVYAQAPLAGEKITA

SEQ ID NO: 619 - protein, 56 aa, Human adenovirus C; identical to SEQ ID NO: 615

SEQ ID NO: 620 - protein, 56 aa, Human adenovirus C; identical to SEQ ID NO: 617

SEQ ID NO: 621 - protein, 56 aa, Human adenovirus C
YMRTCGMFVYSPVSEPEPEPEPEPEPARPTRRPKMVPAILRRPTSPVSRECNSSTD

SEQ ID NO: 622 - protein, 56 aa, Human adenovirus C
TVSPPLKKTKSNINLEISAPLTVTSEALTVAAAAPLMVAGNTLTMQSQAPLTVHDS

SEQ ID NO: 623 - protein, 56 aa, Human adenovirus C
DRGPTFKPYSGTAYNALAPKGAPNSCEWEQEEPTQEMAEELEDEEEAEEEEEAEEE

SEQ ID NO: 624 - protein, 56 aa, Human adenovirus C
AYNALAPKGAPNSCEWEQNETAQVDAQELDEEENEANEAQAREQEQAKKTHVYAQA

SEQ ID NO: 625 - protein, 56 aa, Human adenovirus C
TVTQPLKKTKSNISLDTSAPLTITSGALTVATTAPLIVTSGALSVQSQAPLTVQDS

SEQ ID NO: 626 - protein, 56 aa, Human adenovirus C
TTFPVEAPPLEEEEVIIEQDPGFVSEDDEDRSVPTEDKKQDQDNAEANEEQVGRGD

SEQ ID NO: 627 - protein, 56 aa, Human adenovirus C
KLSIATQGPLTVSEGKLALQTSGPLTTTDSSTLTITASPPLTTATGSLGIDLKEPI

SEQ ID NO: 628 - protein, 56 aa, Human adenovirus C
TVATTAPLIVTSGALSVQSQAPLTVQDSKLSIATKGPITVSDGKLALQTSAPLSGS

SEQ ID NO: 629 - protein, 56 aa, Human adenovirus C
MSANSFDGSIVSSYLTTRMPPWAGVRQNVMGSSIDGRPVLPANSTTLTYETVSGTP

SEQ ID NO: 630 - protein, 56 aa, Human adenovirus C
EDSSQDALVPRTPSPRPSTSTADLAIASKKKKKRPSPKPERPPSPEVIVDSEEERE

SEQ ID NO: 631 - protein, 56 aa, Human adenovirus C
TSHGMLALKMGSGLALDKAGNLTSQNITTVTEPLKKTKSNISLETSAPLTVTSGIL

SEQ ID NO: 632 - protein, 56 aa, Human adenovirus C
TVTEPLKKTKSNISLETSAPLTVTSGILTVATAAPLVVAGNSLTVQSQAPLTVQDS

SEQ ID NO: 633 - protein, 56 aa, Human adenovirus C
AYNALAPKGAPNSCEWEQEEPTQEMAGELEDEEEAEEEEAEEEAEAPQAGQKVKKT

SEQ ID NO: 634 - protein, 56 aa, Human adenovirus C
VMGSSIDGRPVLPANSTTLTYETVSGTPLETAASAAASAAAATARGIVTDFAFLSP

SEQ ID NO: 635 - protein, 56 aa, Human adenovirus C
MATTSPLVISDNTLTMQSQAPLTVQDSKLSIATKEPLTVLDGKLALQTSAPLSATG

SEQ ID NO: 636 - protein, 56 aa, Human adenovirus C
LSIATKEPLTVLDGKLALQTSAPLSATGNNALTITTSPPLTTANGSLAVTMENPLY

SEQ ID NO: 637 - protein, 56 aa, Human adenovirus C
ERLGEFAYGKRHKDMLALPLDEGNPTPSLKPVTLQQVLPTLAPSEEKRGLKRESGD

SEQ ID NO: 638 - protein, 56 aa, Human adenovirus C
TVATAAPLVVAGNSLTVQSQAPLTVQDSKLSIATKGPLTVSEGKLALQTSGPLSAT

SEQ ID NO: 639 - protein, 56 aa, Human adenovirus C
DVALQMVGFSNPPVLIKHGKGGKRTVRRLNEDDPVARGMRTQEEKEESSEAESEST

SEQ ID NO: 640 - protein, 56 aa, Human adenovirus C
PAPGSPEPPHLSRQPEQPEQRALGPVSMPNLVPEVIDLTCHEAGFPPSDDEDEEGE

SEQ ID NO: 641 - protein, 56 aa, Human adenovirus C; identical to SEQ ID NO: 640

SEQ ID NO: 642 - protein, 56 aa, Human adenovirus C
SLDKQYWNFRNGDSTNGQPYTYAVGFMPNLKAYPKTQSKTAKSNIVSQVYLNGDKS

SEQ ID NO: 643 - protein, 56 aa, Human adenovirus C
KLSIATKGPLTVSEGKLALQTSGPLSATDNNTLTITTSPPITTTNGSLGVNMENPL

SEQ ID NO: 644 - protein, 40 aa, Human adenovirus C
PTRRPKMVPAILRRPTSPVSRECNSSTDSCDSGPSNTPPE

SEQ ID NO: 645 - protein, 56 aa, Human adenovirus C
LETAASAAASAAAATARGIVTDFAFLSPLASSAASRSSARDDKLTALLAQLDSLTR

SEQ ID NO: 646 - protein, 56 aa, Human adenovirus C
SSLSDLGAAAPRSDASSPFPSLIGSFTSTRTTRPRLLGEEEYLNNSLLQPQREKNL

SEQ ID NO: 647 - protein, 56 aa, Human adenovirus C
KLSIATKGPITVSDGKLALQTSAPLSGSDSDTLTVTASPPLTTATGSLGINMEDPI

SEQ ID NO: 648 - protein, 56 aa, Human adenovirus C
TSNGMLALKMGNGLSLDEAGNLTSQNVTTVSPPLKKTKSNINLEISAPLTVTSEAL

SEQ ID NO: 649 - protein, 56 aa, Human adenovirus C; identical to SEQ ID NO: 615

SEQ ID NO: 650 - protein, 56 aa, Human adenovirus C
TTSPPPWSEPDAEISRRKRSSSSWPKSPIKTTQETCRRFCARPPSTTPKLILSNSL

SEQ ID NO: 651 - protein, 56 aa, Human adenovirus C
RHYLDLEEGEGLARLGAPSPERHPRVQLKRDTREAYVPRQNLFRDREGEEPEEMRD

SEQ ID NO: 652 - protein, 56 aa, Human adenovirus C
SLHDLYDLDVTAPEDPNEEAVSQIFPESVMLAVQEGIDLFTFPPAPGSPEPPHLSR

SEQ ID NO: 653 - protein, 56 aa, Human adenovirus C
MRHIICHGGVITEEMAASLLDQLIEEVLADNLPPPSHFEPPTLHELYDLDVTAPED

SEQ ID NO: 654 - protein, 56 aa, Human adenovirus C
FKPYSGTAYNALAPKGAPNPCEWDEAATALEINLEEEDDDNEDEVDEQAEQQKTHV

SEQ ID NO: 655 - protein, 56 aa, Human adenovirus C
LNEDDPVARGMRTQEEKEESSEAESESTVINPLSLPIVSAWEKGMEAARALMDKYH

SEQ ID NO: 656 - protein, 56 aa, Human adenovirus C
PDVRIIENHGTEDELPNYCFPLGGIGVTDTYQAIKANGNGSGDNGDTTWTKDETFA

SEQ ID NO: 657 - protein, 56 aa, Human adenovirus C
SRLSNLLGIRKRQPFQEGFRITYDDLEGGNIPALLDVDAYQASLKDDTEQGGDGAG

SEQ ID NO: 658 - protein, 56 aa, Human adenovirus C
EQAAITTTPRNNLNPRSWPAALVYQESPAPTTVVLPRDAQAEVQMTNSGAQLAGGF

SEQ ID NO: 659 - protein, 56 aa, Human adenovirus C; identical to SEQ ID NO: 653

SEQ ID NO: 660 - protein, 56 aa, Human adenovirus C
VMLAVQEGIDLFTFPPAPGSPEPPHLSRQPEQPEQRALGPVSMPNLVPEVIDLTCH

SEQ ID NO: 661 - protein, 56 aa, Human adenovirus C
AKPTNENGGQGILVKQPNGKLESQVEMQFFSTTEAAAVNGDNLTPKVVLYSEDVDI

SEQ ID NO: 662 - protein, 56 aa, Human adenovirus C
NPFGGQSVLVPDEKGVPLPKVDLQFFSNTTSLNDRQGNATKPKVVLYSEDVNMETP

SEQ ID NO: 663 - protein, 56 aa, Human adenovirus C
QPEQPEQRALGPVSMPNLVPEVIDLTCHEAGFPPSDDEDEEGEEFVLDYVEHPGHG

SEQ ID NO: 664 - protein, 56 aa, Human adenovirus C
MRADREELDLPPPVGGVAVDVVKVEVPATGRTLVLAFVKTCAVLAAVHGLYILHEV

SEQ ID NO: 665 - protein, 51 aa, Human adenovirus C
GADLRWAPSRRALEAAGAGPGLAVAPARAGNVGGVEEYDEDDEYEPEDGEY

SEQ ID NO: 666 - protein, 56 aa, Human adenovirus C
SGRAVAEDEEEEDEDEEEEEEEQNARDQATKKTHVYAQAPLSGETITKSGLQIGSD

SEQ ID NO: 667 - protein, 54 aa, Human adenovirus C
GPSAVVVTRPSRASLRRAASGPRSMRPVASGNWQSTLNSIVGLGVQSLKRRRCF

SEQ ID NO: 668 - protein, 56 aa, Human adenovirus C; identical to SEQ ID NO: 616

SEQ ID NO: 669 - protein, 56 aa, Human adenovirus C
PNEEAVSQIFPDSVMLAVQEGIDLLTFPPAPGSPEPPHLSRQPEQPEQRALGPVSM

SEQ ID NO: 670 - protein, 56 aa, Human adenovirus C
AAAGAEPMEPESRPGPSGMNVVQVAELYPELRRILTITEDGQGLKGVKRERGACEA

SEQ ID NO: 671 - protein, 56 aa, Human adenovirus C
AAAAATAAATQKQRRPDSKTLTKPKKSTAAAAAGGGALRLAPNEPVSTRELRNRIF

SEQ ID NO: 672 - protein, 56 aa, Human adenovirus C
MPKGAWSTAASGTREASTPSRSSWPASPTTSPPPWSEPDAEISRRKRSSSSWPKSP

SEQ ID NO: 673 - protein, 56 aa, Human adenovirus C
LDEEENEANEAQAREQEQAKKTHVYAQAPLSGIKITKEGLQIGTADATVAGAGKEI

SEQ ID NO: 674 - protein, 37 aa, Human adenovirus C
ELPRMVVPEFKWSTKHQYRNVSLPVAHSDARQNPFDF

SEQ ID NO: 675 - protein, 56 aa, Human adenovirus C
LTPPFVSPNGFQESPPGVLSLRLSEPLVTSHGMLALKMGSGLALDKAGNLTSQNIT

SEQ ID NO: 676 - protein, 56 aa, Human adenovirus C
ADANAAGGRVLKKTTPMKPCYGSYARPTNPFGGQSVLVPDEKGVPLPKVDLQFFSN

SEQ ID NO: 677 - protein, 56 aa, Human adenovirus C
LARPPAPTITTVSENVPALTDHGTLPLRNSIGGVQRVTITDARRRTCPYVYKALGI

SEQ ID NO: 678 - protein, 56 aa, Human adenovirus C
LTEGTAYTNAVGFMPNLSAYPKSHGKTAKSNIVSQVYLNGDKTKPVTLTITLNGTQ

SEQ ID NO: 679 - protein, 56 aa, Human adenovirus C
KGKLRAKGHAAEGLDYDTMVKCYLADAQGEDRQRFSTSRTSLKRTLASAQPGAHPF

SEQ ID NO: 680 - protein, 56 aa, Human adenovirus C
LTPPFVSPNGFQESPPGVLSLRVSEPLDTSHGMLALKMGSGLTLDKAGNLTSQNVT

SEQ ID NO: 681 - protein, 56 aa, Human adenovirus C
LTNATAYTNAVGFMPNLKAYPKTQSRTAKSNIVSQVYLNGEKEKPMTLTITLNGTD

SEQ ID NO: 682 - protein, 37 aa, Human adenovirus C
KPVAVRVGGRRQAVECIEDLLNESGQPLDLSCKRPRP

SEQ ID NO: 683 - protein, 56 aa, Human adenovirus C; identical to SEQ ID NO: 658

SEQ ID NO: 684 - protein, 56 aa, Human adenovirus C; identical to SEQ ID NO: 653

SEQ ID NO: 685 - protein, 33 aa, Human adenovirus C
RSCLYHKSEDQLRRTLEDAEALFSKYCALTLKD

SEQ ID NO: 686 - protein, 56 aa, Human adenovirus C
MMQDATDPAVRAALQSQPSGLNSTDDWRQVMDRIMSLTARNPDAFRQQPQANRLSA

SEQ ID NO: 687 - protein, 56 aa, Human adenovirus C
KKTTPMKPCYGSYAKPTNENGGQGILVKQQNGKLESQVEMQFFSTTEATAGNGDNL

SEQ ID NO: 688 - protein, 56 aa, Human adenovirus C
LFTASNNSKKLEVNLSTAKGLMFDATAIAINAGDGLEFGSPNAPNTNPLKTKIGHG

SEQ ID NO: 689 - protein, 56 aa, Human adenovirus C
PELRRILTITEDGQGLKGVKRERGACEATEEARNLAFSLMTRHRPECITFQQIKDN

SEQ ID NO: 690 - protein, 56 aa, Human adenovirus C
QIIGTFELQGPSPDEKSAAPGLKLTPGLWTSAYLRKFVPEDYHAHEIRFYEDQSRP

SEQ ID NO: 691 - protein, 56 aa, Human adenovirus C
DSSTLTITASPPLTTATGSLGIDLKEPIYTQNGKLGLKYGAPLHVTDDLNTLTVAT

SEQ ID NO: 692 - protein, 56 aa, Human adenovirus C
QWNETEINHAAGRVLKKTTPMKPCYGSYAKPTNENGGQGILVKQPNGKLESQVEMQ

SEQ ID NO: 693 - protein, 56 aa, Human adenovirus C
VEQPGHGCRSCHYHRRNTGDPDIMCSLCYMRTCGMFVYSPVSEPEPEPEPEPEPAR

SEQ ID NO: 694 - protein, 56 aa, Human adenovirus C
ALESKVEMQFFAPSGTAMNERNAVQPSIVLYSEDVNMETPDTHISYKPSKTDENSK

SEQ ID NO: 695 - protein, 56 aa, Human adenovirus C
RKFHAGRELRHGLNRERLLREEDFEPDARTGISPARAHVAAADLVTAYEQTVNQEI

SEQ ID NO: 696 - protein, 56 aa, Human adenovirus C
KRDTREAYVPRQNLFRDREGEEPEEMRDRKFHAGRELRHGLNRERLLREEDFEPDA

SEQ ID NO: 697 - protein, 56 aa, Human adenovirus C
PNEEAVSQIFPESVMLAVQEGIDLFTFPPAPGSPEPPHLSRQPEQPEQRALGPVSM

SEQ ID NO: 698 - protein, 56 aa, Human adenovirus C
MKRARPSEDTFNPVYPYDTETGPPTVPFLTPPFVSPNGFQESPPGVLSLRVSEPLD

SEQ ID NO: 699 - protein, 56 aa, Human adenovirus C
GESQWNEAEATASGGRVLKKTTPMKPCYGSYARPTNKNGGQGILVANNQGALESKV

SEQ ID NO: 700 - protein, 55 aa, Human adenovirus C
MKIVGAEGQEHEEFDIPFRLWRKFAAKRLLKYQSWEEGKEVMLNKLDKDLLTDFK

SEQ ID NO: 701 - protein, 56 aa, Human adenovirus C
NNALTITTSPPLTTANGSLAVTMENPLYNNNGKLGLKIGGPLQVATDSHALTLGTG

SEQ ID NO: 702 - protein, 56 aa, Human adenovirus C
TSHGMLALKMGSGLSLDQAGNLTSNTITVSQPLKKTKSNITLETSAPLTVSSGALT

SEQ ID NO: 703 - protein, 56 aa, Human adenovirus C
NHGTEDELPNYCFPLGGIGVTDTYQGIKSNGNGNPQNWTKNDDFAARNEIGVGNNF

SEQ ID NO: 704 - protein, 56 aa, Human adenovirus C
TTSLNDRQGNATKPKVVLYSEDVNMETPDTHLSYKPGKGDENSKAMLGQQSMPNRP

SEQ ID NO: 705 - protein, 56 aa, Human adenovirus C
PLVTAARDLAANLGWDRWEQDPLTFYCITPEKMAIGRQFRTFRDHLQMLMARDLWS

SEQ ID NO: 706 - protein, 56 aa, Human adenovirus C
IVSAVSLPHGSPPPTHNRDMTGGVFQLRPRENGRAVTETMRRRRGEMIERFVDRLP

SEQ ID NO: 707 - protein, 56 aa, Human respiratory syncytial virus; identical to SEQ ID NO: 7

SEQ ID NO: 708 - protein, 56 aa, Human respiratory syncytial virus; identical to SEQ ID NO: 35

SEQ ID NO: 709 - protein, 56 aa, Human respiratory syncytial virus
AQPNKSTTKQRQNKPPSKPNNDFHFEVFNFVPCSICSNNPTCWAICKRIPNKKPGK

SEQ ID NO: 710 - protein, 56 aa, Human respiratory syncytial virus
HFEVFNFVPCSICGNNQLCKSICKTIPSNKPKKKPTIKPTNKPPTKTTNKRDSKTL

SEQ ID NO: 711 - protein, 56 aa, Human respiratory syncytial virus
ISTQTNKPSTKPRPKNPPKKPKDDYHFEVFNFVPCSICGNNQLCKSICKTIPSNKP

SEQ ID NO: 712 - protein, 56 aa, Human respiratory syncytial virus
TQNNKPSTKPRPKNPPKKPKDDYHFEVFNFVPCSICGNNQLCKSICKTIPNNKPKK

SEQ ID NO: 713 - protein, 56 aa, Human respiratory syncytial virus
KSRSKNPPKKPKDDYHFEVFNFVPCSICGNNQLCKSICKTIPSNKPKKKPTIKPTN

SEQ ID NO: 714 - protein, 56 aa, Human respiratory syncytial virus
NKPSTKPRPKNPPKKPKDDHHFEVFNFVPCSICGNNQLCKSICKTIPSNKPKKKPT

SEQ ID NO: 715 - protein, 56 aa, Human respiratory syncytial virus
TTKQRQNKPPNKPNNDFHFEVFNFVPCSICSNNPTCWAICKRIPSKKPGKKTTTKP

SEQ ID NO: 716 - protein, 56 aa, Human respiratory syncytial virus
TTTTQIQPSKLTTKQRQNKPPNKPNDDFPFEVFNFVPCSICSNNPTCWAICKRIPS

SEQ ID NO: 717 - protein, 56 aa, Human respiratory syncytial virus
KPSTKSRSKNPPKKPKDDYHFEVFNFVPCSICGNNQLCKSICKTIPSNKPKKKPTI

SEQ ID NO: 718 - protein, 56 aa, Human respiratory syncytial virus
LQPSKPTTKQRHNKPPNKPNNDFHFEVFNFVPCSICSNNPTCWAICKRIPNKKPGK

SEQ ID NO: 719 - protein, 56 aa, Human respiratory syncytial virus
NTTITQIQPSKPTTKQRQNKPPNKPNDDFHFEVFNFVPCSICSNNPTCWAICKRIP

SEQ ID NO: 720 - protein, 56 aa, Human respiratory syncytial virus
RTTTPTQNNKPSTKPRPKNPPKKPKDDYHFEVFNFVPCSICGNNQLCKSICKTIPS

SEQ ID NO: 721 - protein, 56 aa, Human respiratory syncytial virus
NKPSTKPHPKIPPKKPKDDYHFEVFNFVPCSICGNNQLCKSICKTIPSNKPKKKPT

SEQ ID NO: 722 - protein, 56 aa, Human respiratory syncytial virus
NKPPNKPNNDFHFEVFNFVPCSICSNNPTCWAICKRIPNKKPGKKTTTKPTKKPTI

SEQ ID NO: 723 - protein, 56 aa, Human respiratory syncytial virus
TQPSKPTTKQRQNKPPSKPNNDFHFEVFNFVPCSICSNNPTCWAICKRIPNKKPGK

SEQ ID NO: 724 - protein, 56 aa, Human respiratory syncytial virus
IQPSKPTTKQRQNKPPNKPNNDFHFEVFNFVPCSICSNNPTCWAICKRIPNKKPGK

SEQ ID NO: 725 - protein, 56 aa, Human respiratory syncytial virus
AQPNKPTTKQRQNKPPSKPNNDFHFEVFNFVPCSICSNNPTCWAICKRIPNKKPGK

SEQ ID NO: 726 - protein, 56 aa, Human respiratory syncytial virus
SKPTTKQRQNKPQNKPNNDFHFEVFNFVPCSICSNNPTCWAICKRIPNKKPGKKTT

SEQ ID NO: 727 - protein, 56 aa, Human respiratory syncytial virus
EVFNFVPCSICGNNQLCKSICKTIPSNKPKKKPTIKPTNKPPTKTTNKRDPKTLAK

SEQ ID NO: 728 - protein, 56 aa, Human respiratory syncytial virus
PFEVFNFVPCSICSNNPTCWAICKRIPSKKPGRKTPPKPTKKPTFKTPKKDLKPQT

SEQ ID NO: 729 - protein, 56 aa, Human respiratory syncytial virus
NNDFHFEVFNFVPCSICSNNPTCWAICKRIPNKKPGKKTTTKPTKKPTIKTTKKDP

SEQ ID NO: 730 - protein, 56 aa, Human respiratory syncytial virus
KPRPKIPPKKPKDDYHFEVFNFVPCSICGNNQLCKSICKTIPSNKPKKKPTIKPTN

SEQ ID NO: 731 - protein, 56 aa, Human respiratory syncytial virus
NFVPCSICSNNPTCWAICKRIPNKKPGKKTTTKPTKRPTTRTTKKDLKPQTTKPKG

SEQ ID NO: 732 - protein, 56 aa, Human respiratory syncytial virus
ILPSKPTTKQRQNKPQNKPNNDFHFEVFNFVPCSICSNNPTCWAICKRIPNKKPGK

SEQ ID NO: 733 - protein, 56 aa, Human respiratory syncytial virus; identical to SEQ ID NO: 7

SEQ ID NO: 734 - protein, 56 aa, Human respiratory syncytial virus
NKPSTKPRLKNPPKKDDYHFEVFNFVPCSICGNNQLCKSICKTIPSNKPKKKPTIK

SEQ ID NO: 735 - protein, 56 aa, Human respiratory syncytial virus
TQTNKPSTKPRPKNPPKKPKDDYHFEVFNFVPCSICGNNQLCKSICKTIPSNKPKK

SEQ ID NO: 736 - protein, 56 aa, Human respiratory syncytial virus
VFNFVPCSICGNNQLCKSICKTIPSNKPKKKPTIKPTNKPTTKTTNKKDPKTPAKT

SEQ ID NO: 737 - protein, 56 aa, Human respiratory syncytial virus
TPSAESTPQSTTVKTKNTTTTQIQPSKPTTKQRQNKPPNKPNNDFHFEVFNFVPCS

SEQ ID NO: 738 - protein, 56 aa, Human respiratory syncytial virus
NTTTTQIQPSKPTTKQRQNKPPNKPNNDFHFEVFNFVPCSICSNNPTCWAICKRIP

SEQ ID NO: 739 - protein, 56 aa, Human respiratory syncytial virus
FHFEVFNFVPCSICSNNPTCWAICKRIPNKKPGKKTTTKPTKKPTIKTTKKDLKPQ

SEQ ID NO: 740 - protein, 56 aa, Human respiratory syncytial virus
TTKQRQNKPPNKPNNDLHFEVFNFVPCSICSNNPTCWAICKRIPNKKPGKKTTTKP

SEQ ID NO: 741 - protein, 56 aa, Human respiratory syncytial virus
KIKNTTTTQIQPSKPTTKQRQNKPQNKPNNDFHFEVFNFVPCSICSNNPTCWAICK

SEQ ID NO: 742 - protein, 56 aa, Human respiratory syncytial virus
TQTNKPSTKSRSKNPPKKPKDDYHFEVFNFVPCSICGNNQLCKSICKTIPSNKPKK

SEQ ID NO: 743 - protein, 56 aa, Human respiratory syncytial virus
NTTTTQMQPSEPTTKQRQNKPQNKPNNDFHFEVFNFVPCSICSNNPTCWAICKRIP

SEQ ID NO: 744 - protein, 56 aa, Human respiratory syncytial virus
NFVPCSICGNNQLCKSICKTIPSNKPKKKPTIKPTNKPTTKTTNKKDPKTPAKTLK

SEQ ID NO: 745 - protein, 56 aa, Human respiratory syncytial virus
NFVPCSICSNNPTCWAICKRIPNKKPGKRTTTKPTKKPTLKTTKKDPKPQTTKSEE

SEQ ID NO: 746 - protein, 56 aa, Human respiratory syncytial virus
PAQTNRPSTKPRPKNPPKKPKDDYHFEVFNFVPCSICGNNQLCKSICKTIPSNKPK

SEQ ID NO: 747 - protein, 56 aa, Human respiratory syncytial virus
TTKQRQNKPPSKPNNDFHFEVFNFVPCSICSNNPTCWAICKRIPNKKPGKRTTTKP

SEQ ID NO: 748 - protein, 56 aa, Human respiratory syncytial virus
FHFEVFNFVPCSICSNNPTCWAICKRIPSKKPGKKTTTKPTKKPTIKTTKKDLKPQ

SEQ ID NO: 749 - protein, 56 aa, Human respiratory syncytial virus
IQPSKPTTKQHQNKPPNKPNNHFHFEVFNFVPCSICSNNPTCWAICKRIPNKKPGK

SEQ ID NO: 750 - protein, 56 aa, Human respiratory syncytial virus
NFVPCSICGNNQLCKSICKTIPSNKPKKKPTIKPTNKPTTKTTNKRDPKTPAKMPK

SEQ ID NO: 751 - protein, 56 aa, Human respiratory syncytial virus
TPSAESTPQSTTVKTKNTTTTQIQPSKPTTKQRQNKPQNKPNNDFHFEVFNFVPCS

SEQ ID NO: 752 - protein, 56 aa, Human respiratory syncytial virus
NFVPCSICSNNPTCWAICKRIPSKKPGKKTTTKPTKKPTIKTTKKDHKPQTTKPKE

SEQ ID NO: 753 - protein, 56 aa, Human respiratory syncytial virus
FNFVPCSICGNNQLCKSICKTIPSNKPKKKPTIKPTNKPPTKTTNKRDSKTLAKTL

SEQ ID NO: 754 - protein, 56 aa, Human respiratory syncytial virus
PTTKQRQNKPPNKPNDDFHFEVFNFVPCSICSNNPTCWAICKRIPSKKPGKKTTTK

SEQ ID NO: 755 - protein, 56 aa, Human respiratory syncytial virus
TQTNKPSTKPRLKNPPKKPKDDYHFEVFNFVPCSICGNNQLCKSICKTIPSNKPKK

SEQ ID NO: 756 - protein, 38 aa, Human respiratory syncytial virus
TSTPTQNNKPSTKPRPKNPPKKDDYHFEVFNFVPCSIC

SEQ ID NO: 757 - protein, 56 aa, Human respiratory syncytial virus
TTPSVEPTPQSTTVKTKNTTTTQTQPSKPTTKQRQNKPPNKPNDDFHFEVFNFVPC

SEQ ID NO: 758 - protein, 56 aa, Human respiratory syncytial virus
NTKSETHHTTAQTKGRTTTSTQTNKPSTKPRPKNPPKKPKDDYHFEVFNFVPCSIC

SEQ ID NO: 759 - protein, 56 aa, Human respiratory syncytial virus
NFVPCSICSNNPTCWAICKRIPNKKPGKKTTTKPTKKPTLKTTKKDPKPQTTKPKE

SEQ ID NO: 760 - protein, 56 aa, Human respiratory syncytial virus
QKNNRLLEITREFSVNAGVTTPVSTYMLTNSELLSLINDMPITNDQKKLMSNNVQI

SEQ ID NO: 761 - protein, 56 aa, Human respiratory syncytial virus
NFVPCSICSNNPTCWAICKRIPNKKPGKRTTTKPTKKPTPKTTKKGPKPQTTKSKE

SEQ ID NO: 762 - protein, 56 aa, Human respiratory syncytial virus
SKPTTKQRQNKPPSKPNDDFHFEVFNFVPCSICSNNPTCWAICKRIPNKKPRKKTT

SEQ ID NO: 763 - protein, 56 aa, Human respiratory syncytial virus
TTKQRQNKPQNKPNNDFHFEVFNFVPCSICSNNPTCWAICKRIPNKKPGKKTTTKP

SEQ ID NO: 764 - protein, 56 aa, Human respiratory syncytial virus
PCSICGNNQLCKSICKTIPSNKPKKKPTVKPTNKPPTKITNKRDPKTLAKTLKKEE

SEQ ID NO: 765 - protein, 56 aa, Human respiratory syncytial virus
CSICGNNQLCKSICKTIPSNKPKKKPTIKPTNKPTTKTTNKRDPKTSAKMSKKEII

SEQ ID NO: 766 - protein, 56 aa, Human respiratory syncytial virus
TNSATISPNTKSETHHTTAQTKGRTTTPTQNNKPSTKPRPKNPPKKPKDDYHFEVF

SEQ ID NO: 767 - protein, 56 aa, Human respiratory syncytial virus
ATTSPNTKSETHHTTAQTKGRTTTSTQTNKPSTKPRLKNPPKKDDYHFEVFNFVPC

SEQ ID NO: 768 - protein, 56 aa, Human respiratory syncytial virus
ATTSPNTKSETHHTTAQTKGRTTTSTQTNKPSTKPRPKNPPKKPKDDHHFEVFNFV

SEQ ID NO: 769 - protein, 56 aa, Human respiratory syncytial virus
FEAFNFVPCSICSNNPTCWAICKRIPNKKPGKKTTTKPTKKPTINTTKKDLKPQTT

SEQ ID NO: 770 - protein, 56 aa, Human respiratory syncytial virus
TTSQPITILASTTPSAELTPQSTTVKIKNTTTTQMQPSEPTTKQRQNKPQNKPNND

SEQ ID NO: 771 - protein, 56 aa, Human respiratory syncytial virus
VSCYGKTKCTASNKNRGIIKTFSNGCDYVSNKGVDTVSVGNTLYYVNKQEGKSLYV

SEQ ID NO: 772 - protein, 56 aa, Human respiratory syncytial virus
TTPSAESTPQSTTVKTKNTTTAQIQPSKSTTKQRQNKPQNKPNNDFHFEVFNFVPC

SEQ ID NO: 773 - protein, 56 aa, Human respiratory syncytial virus
TNSATISPNTKSETHHTTAQTKGRITTSTQTNKPSTKSRSKNPPKKPKDDYHFEVF

SEQ ID NO: 774 - protein, 56 aa, Human respiratory syncytial virus
NTTTTQMQPSKPTTKQRQNKPQNKPNNDFHFEVFNFVPCSICSNNPTCWAICKRIP

SEQ ID NO: 775 - protein, 56 aa, Human respiratory syncytial virus
LQPTTVKTKNTTTTQTQPSKPTTKQRQNKPPNKPNNDFHFEVFNFVPCSICSNNPT

SEQ ID NO: 776 - protein, 56 aa, Human respiratory syncytial virus
NSTTISPNTKSEKHHTTAQTKGRTTTSTQTNKPSTKPRPKNPPKKPKDDYHFEVFN

SEQ ID NO: 777 - protein, 56 aa, Human respiratory syncytial virus
KGEPIINFYDPLVFPSDEFDASISQVNEKINQSLAFIRKSDELLHNVNVGKSTTNI

SEQ ID NO: 778 - protein, 56 aa, Human respiratory syncytial virus
TILASTTPSAESTPQSTTVKIKNTTTTQIQPSKPTTKQRQNKPQNKPNNDFHIEVF

SEQ ID NO: 779 - protein, 56 aa, Human respiratory syncytial virus
TPSVESTPQSTTVKTKNTTTTQIQPSKSTTKQRQNKPPNKPNNDLHFEVFNFVPCS

SEQ ID NO: 780 - protein, 40 aa, Human respiratory syncytial virus
IQPSKPTTKQRQNKPQNKPNNDFHIEVFNIVPCSICSNNP

SEQ ID NO: 781 - protein, 56 aa, Human respiratory syncytial virus
TILDSTTPGVKSTLQSTTVGTKNTTTTQAQPNKPTTKQRQNKPPSKPNNDFHFEVF

SEQ ID NO: 782 - protein, 56 aa, Human respiratory syncytial virus
ISQTTAILAPTTPSVEPILQSTTVKAKNTTTTQIQPSKLTTKQRQNKPPNKPNDDF

SEQ ID NO: 783 - protein, 56 aa, Human respiratory syncytial virus
PCSICGNNQLCKSICKTIPSNKPKKKPTIKPTNKPTTKTTNKRDPKTPAKTTKKET

SEQ ID NO: 784 - protein, 56 aa, Human respiratory syncytial virus
KNPPKKPKDDYHFEVFNFVPCSICGNNQLCKSICKTIPSNKPKKKPTIKPTNKPPT

SEQ ID NO: 785 - protein, 56 aa, Human respiratory syncytial virus
TTSQPITILASTTPSAESTPQSTTVKIKNTTTTQMQPSKPTTKQRQNKPQNKPNND

SEQ ID NO: 786 - protein, 56 aa, Human respiratory syncytial virus
KPPNKPNNDFHFEVFNFVPCSICSNNPTCWAICKRIPNKKPGKKTTTKPTKKPTFK

SEQ ID NO: 787 - protein, 56 aa, Human respiratory syncytial virus
TTKQRQNKPPNKPNNDFHFEVFNFVPCSICSNNPTCWAICKRIPNKKPGKKTTTKP

SEQ ID NO: 788 - protein, 56 aa, Human respiratory syncytial virus
AILALTTPSVESILQSTTVKTKNTTTTQIQPSKPTTKQRQNKPPNKPNNDFHFEVF

SEQ ID NO: 789 - protein, 56 aa, Human respiratory syncytial virus
SQTTAILAPTTPSVEPILQSTTVKTKNTTTTQIQPSKLTTKQRQNKPPNKPNDDFH

SEQ ID NO: 790 - protein, 56 aa, Human respiratory syncytial virus
ASTTPGVKSTLQSTTVKTKNTTTTQTQPSKPTTKQRQNKPPSKPNDDFHFEVFNFV

SEQ ID NO: 791 - protein, 56 aa, Human respiratory syncytial virus
KCTASNKNRGIIKTFSNGCDYVSNKGVDTVSVGNTLYYVNKLEGKNLYVKGEPIIN

SEQ ID NO: 792 - protein, 56 aa, Human respiratory syncytial virus
TISQTTAILALTTPSVESILQSTTVKTKNTTTTQIQPSKPTTKQRQNKPPNKPNDD

SEQ ID NO: 793 - protein, 56 aa, Human respiratory syncytial virus
ATISLNTKSETHHTTAQTKGRTTTPTQNNKPSTKPRPKNPPKKPKDDYHFEVFNFV

SEQ ID NO: 794 - protein, 56 aa, Human respiratory syncytial virus
NTKSETHHTTAQTKGRITTSTQTNKPSTKSRSKNPPKKPKDDYHFEVFNFVPCSIC

SEQ ID NO: 795 - protein, 56 aa, Human respiratory syncytial virus
SKPKEVPTTKPTEKPTINIPKPKIRTSLFTNSTTGNLEPPSQEETLHSTSSEGNTS

SEQ ID NO: 796 - protein, 56 aa, Human respiratory syncytial virus
TTSQPTTTPALATPSAESTLQSTIVKTKNITTTQIQPSKPTTKQRQNKPPNKPNND

SEQ ID NO: 797 - protein, 56 aa, Human respiratory syncytial virus
IKPTNKPTTKTTNKRDSKTSAKALRKETTTDPTKEPTLKTTERDTSTSRSTVLDTT

SEQ ID NO: 798 - protein, 31 aa, Human respiratory syncytial virus
NTTTTQMQPSKPTTKQRQNKPQNKPNNDFHF

SEQ ID NO: 799 - protein, 56 aa, Human respiratory syncytial virus
TILASTTPSAESTPQSTTVKIKNTTTTQILPSKPTTKQRQNKPQNKPNNDFHFEVF

SEQ ID NO: 800 - protein, 56 aa, Human respiratory syncytial virus
KPRPKNPPKKPKDDYHFEVFNFVPCSICGNNQLCKSICKTIPSNKPKKKPTIKPTN

SEQ ID NO: 801 - protein, 56 aa, Human respiratory syncytial virus
FHFEVFNFVPCSICSNNPTCWAICKRIPNKKPGKKTTTKPTKKPTIKTTKKDPKPQ

SEQ ID NO: 802 - protein, 56 aa, Human respiratory syncytial virus
NFVPCSICGNNQLCKSICKTIPNNKPKKKPTTKPTNKPPTKTTNKRDPKTPAKTLK

SEQ ID NO: 803 - protein, 56 aa, Human respiratory syncytial virus
TPSVESTLQSTTVKTKNTTTTQTQPSKPTTKQRQNKPPNKPNNDFHFEVFNFVPCS

SEQ ID NO: 804 - protein, 56 aa, Human respiratory syncytial virus
TPGVKSTLQSTTVGTKNTTTTQAQPNKPTTKQRQNKPPSKPNNDFHFEVFNFVPCS

SEQ ID NO: 805 - protein, 56 aa, Human respiratory syncytial virus
ATISPNTKSETHHTTAQTKGRTTTPTQTNKPSTKPHPKIPPKKPKDDYHFEVFNFV

SEQ ID NO: 806 - protein, 56 aa, Human respiratory syncytial virus
TPPIHTNSATISPNTKSETHHTTAQTKGRTTTPTQNNKPSTKPRPKNPPKKPKDDY

SEQ ID NO: 807 - protein, 56 aa, Human respiratory syncytial virus
TKPTKKPTIKTTKKDLKPQTTKPKEAPTTKPTEKPTINITKPNIRTTLLTNSTTGN

SEQ ID NO: 808 - protein, 56 aa, Human respiratory syncytial virus
ALTTPSVESILQSTTVKTKNTTTTQIQPSKPATKQRQNKPPNKPNNDFHFEVFNFV

SEQ ID NO: 809 - protein, 56 aa, Human respiratory syncytial virus
NTKSETHHTTAQTKGRTTTPTQTNKPSTKPRPKIPPKKPKDDYHFEVFNFVPCSIC

SEQ ID NO: 810 - protein, 56 aa, Human respiratory syncytial virus
PPIHTNSATISPNTKSETHHTTAQTKGRTSTPTQNNKPSTKPRPKNPPKKDDYHFE

SEQ ID NO: 811 - protein, 56 aa, Human respiratory syncytial virus
KPTNKPTTKTTNKRDPKTSAKMSKKEIITNPTKKPTLKTTERDISTSQSIVLDTIT

SEQ ID NO: 812 - protein, 56 aa, Human respiratory syncytial virus
IFNPKYDCKIMTSKTDVSSSVITSLGAIVSCYGKTKCTASNKNRGIIKTFSNGCDY

SEQ ID NO: 813 - protein, 56 aa, Human respiratory syncytial virus
KKDLKPQTTKPKEAPTTKPTEKPTINITKPNIRTTLLTHSTTGNLEHTSQVETLHS

SEQ ID NO: 814 - protein, 56 aa, Human respiratory syncytial virus
TPSVVPILQSTTVKTKNTTTTQIQPSKLTTKQRQNKPPNKPNDDFHFEVFNFVPCS

SEQ ID NO: 815 - protein, 56 aa, Human respiratory syncytial virus
RDPKTPAKTVKKESTTNPTKKPTLKTTERDTSTPQSTALDTTTSKHTIQQQSLHST

SEQ ID NO: 816 - protein, 56 aa, Human respiratory syncytial virus
NKPPIKTTNKRDPKTLAKTLTKETTTNPTKKPTPKTTERDTSTPQSTVLDTATSGH

SEQ ID NO: 817 - protein, 56 aa, Human respiratory syncytial virus
KTTTKPTKKPTLKTTKKDPKPQTTKPKEVLTTKPTGKPTINTTKTNIRTTLLTSNT

SEQ ID NO: 818 - protein, 56 aa, Human respiratory syncytial virus
STTVKTKNTTTTQIQPSKLTTKQRQNKPQNKPNNDFHFEVFNFVPCSICSNNPTYW

SEQ ID NO: 819 - protein, 56 aa, Human respiratory syncytial virus
TNKPPTKTTNKRDPKTLAKTLKKETTTNPTKKPTPKTTERDTSIPQSTVLDTTTSK

SEQ ID NO: 820 - protein, 56 aa, Human respiratory syncytial virus
NFVPCSICSNNPTCWAICKRIPNKKPGKKTTTKPTKKPTLKTTKKDPKPQTTKSKE

SEQ ID NO: 821 - protein, 56 aa, Human respiratory syncytial virus
YVATINSAILCKTIPSNKPKKKPTIKPTNKPPIKTTNKRDPKTLAKTLTKETTTNP

SEQ ID NO: 822 - protein, 56 aa, Human respiratory syncytial virus
TSNSTIINPTNETDDTVGNKPNYQRKPLVSFKEDPTPSDNPFSKLYKETIETFDNN

SEQ ID NO: 823 - protein, 56 aa, Human respiratory syncytial virus
TPSIESTLLSTTVKTKNTTTTQIQPSKPTTKQRHNKPPNKPNNDFHFEVFNFVPCS

SEQ ID NO: 824 - protein, 56 aa, Human respiratory syncytial virus
ERDTNTPQSTLLDTTTSKHAERDTSTPQSTVLDTTTSKHTIRQQSLYSTTPENTPN

SEQ ID NO: 825 - protein, 35 aa, Human respiratory syncytial virus
QNNKPSTKLRPKNPPKKPKDDYHFEVFNFVPCSIC

SEQ ID NO: 826 - protein, 56 aa, Human respiratory syncytial virus
TKKPTIKTTKKDLKPQTTKPKEAPTTKPTEKPTINITKPNIRTTPLTSSTTGNLEH

SEQ ID NO: 827 - protein, 56 aa, Human respiratory syncytial virus
KRIPNKKPGKKTTTKPTKKPTIKTTKEDLKPQTTTPKEIPTISPTEKSTINTIKTN

SEQ ID NO: 828 - protein, 56 aa, Human respiratory syncytial virus
KRDPKTPAKTLEKETTTNPTKKPTPKTTERGTSTSQSTVLDTTISKHTIQQQSLYS

SEQ ID NO: 829 - protein, 56 aa, Human respiratory syncytial virus
PCSICGNNQLCKSICKTIPSNKPKKKPTIKPTNKPPTKTTNKRDPKTLAKTLKKET

SEQ ID NO: 830 - protein, 56 aa, Human respiratory syncytial virus
TKKQTIKTTKKDLKPQTTKPKEAPTTKPTEKPTINITKPNIRTTLLTNSTTGNLEH

SEQ ID NO: 831 - protein, 56 aa, Human respiratory syncytial virus
TTKPMEAPTTKPTEKPTINITKPNIRTTLLTNSTTGNLEHTSQEETLHSTSSEGNT

SEQ ID NO: 832 - protein, 56 aa, Human respiratory syncytial virus
AIVSCYGKTKCTASNKNRGIIKTFSNGCDYVSNKGVDTVSVGNTLYYVNKQEGKSL

SEQ ID NO: 833 - protein, 56 aa, Human respiratory syncytial virus
IKPTNKPPTKTTNKRDPKTLAKTLKKETTINPTKKPTPKTTERDTSTPQSTVLDTT

SEQ ID NO: 834 - protein, 56 aa, Human respiratory syncytial virus
IKPTNKPTTKTTNKRDPKTPAKTTKKETTTNPTKKPTLKTTERDTSTSQSTVLDTT

SEQ ID NO: 835 - protein, 56 aa, Human respiratory syncytial virus
AILASTTPSVESIPQSTTAKTKNTTTTQIQPSKPTTKQRQNKPPNKPNDDFHFEVF

SEQ ID NO: 836 - protein, 56 aa, Human respiratory syncytial virus
NSATISPNTKSKTHHTTAQTKSRTTTPTQNNKPSTKLRPKNPPKKPKDDYHFEVFN

SEQ ID NO: 837 - protein, 56 aa, Human respiratory syncytial virus
YPAEYAATIQLSGPCAKEYQAKNREGKPPPSPQKNQPMRTPKKISNLTTQNQREAL

SEQ ID NO: 838 - protein, 56 aa, Human respiratory syncytial virus
TISQTTAILALTTPSVESILQSTTVKTKNTTITQIQPSKPTTKQRQNKPPNKPNDD

SEQ ID NO: 839 - protein, 56 aa, Human respiratory syncytial virus
KQDLKPQTTKPREVLTTKPTEKQTINTTKTNIRTTLLTSNTTGNPEHTSQKETLHS

SEQ ID NO: 840 - protein, 56 aa, Human respiratory syncytial virus
QNKPNNDFHFEVFNFVPCSICSNNPTYWAICKRIPNKKPGKKTTTKPTKNPTIKTT

SEQ ID NO: 841 - protein, 56 aa, Human respiratory syncytial virus
PTKKPTIKTTKKDLKPQTTKPKEAPTTKPTDKPTINITKPNIRTTLLTNSTTGNPE

SEQ ID NO: 842 - protein, 56 aa, Human respiratory syncytial virus
KCTASNKDRGIIKTFSNGCDYVSNKGVDTVSVGNTLYYVNKQEGKSLYVKGEPIIN

SEQ ID NO: 843 - protein, 56 aa, Human respiratory syncytial virus
TMSPNTGSETHHATAQTRGRITTSTQTNKPSTKSRSKNPPKKPKDDYHFEVFNFVP

SEQ ID NO: 844 - protein, 56 aa, Human respiratory syncytial virus
QTQPRKPTTKQRQNKPPNKPNNDFPFEGFNFVPCGICSNNPTRGAICKRIPTKKPG

SEQ ID NO: 845 - protein, 56 aa, Human respiratory syncytial virus
KPTIKPTNKPTTKTTNKRDPKTPAKMPKKEIITNPTKKPTLKTTERDTSTSQSTVI

SEQ ID NO: 846 - protein, 56 aa, Human respiratory syncytial virus
KCTASNKNRGIIKTFSNGCDYVSNKGMDTVSVGNTLYYVNKQEGKSLYVKGEPIIN

SEQ ID NO: 847 - protein, 53 aa, Human respiratory syncytial virus
LASITPSAESTPQSTTVKIKNTTTTQIQPSKPTTKQRQNKPQNKPNNDFHFEV

SEQ ID NO: 848 - protein, 56 aa, Human respiratory syncytial virus
CKSICKTIPSNKPKKKPTTKPTNKPPTKTTNKRDPKTLAKTPKKETTINPTKKPTP

SEQ ID NO: 849 - protein, 56 aa, Human respiratory syncytial virus
PCSICGNNQLCKSICKTIPSNKPKKKPTIKPTNKPTTKTTNKRDSKTSAKALRKET

SEQ ID NO: 850 - protein, 56 aa, Human respiratory syncytial virus
KKDLKPQTTRPKEASTTKPTEKPTINTTKPNIRTTLLTNSTTGNLEHTSQEETLHS

SEQ ID NO: 851 - protein, 56 aa, Human respiratory syncytial virus; identical to SEQ ID NO: 785

SEQ ID NO: 852 - protein, 56 aa, Human respiratory syncytial virus
PQSTVLDTSTSKHTERDTSTSQSIVLDTTTSKHTIQQQSLHSITPGNTPNSTQTPT

SEQ ID NO: 853 - protein, 56 aa, Human respiratory syncytial virus
VKPTNKPPTKITNKRDPKTLAKTLKKEETTTNPTKKPTPKTTERDTSTSQSAVLDT

SEQ ID NO: 854 - protein, 56 aa, Human respiratory syncytial virus
TEKPTINITKPNIRTTPLTSSTTGNLEHTSQVETLHSTSSEGNPSSSQVYTTSEYL

SEQ ID NO: 855 - protein, 56 aa, Human respiratory syncytial virus
EGLTTKPTEKPTINTTKPNIKTTLLTSNTTGNLGRTSQKETLYSTTSEGNPSPSQV

SEQ ID NO: 856 - protein, 44 aa, Human respiratory syncytial virus
STVLDTTTSKHTIRQQSLYSTTPENTPNSTQTPTASEPSTSNSN

SEQ ID NO: 857 - protein, 56 aa, Human respiratory syncytial virus
KTTTKPTKKPTIKTTKKDHKPQTTKPKEAPSTKPTEKPTINITKPNIRTTLLTNST

SEQ ID NO: 858 - protein, 56 aa, Human respiratory syncytial virus
TILDPTTPGVKLTLQSTTVRIKNTTTTQAQPNKSTTKQRQNKPPSKPNNDFHFEVF

SEQ ID NO: 859 - protein, 56 aa, Human respiratory syncytial virus
QMNSRLLEITREFSVNAGVTTPLSTYMLTNSELLSLINDMPITNDQKKLMSSNVQI

SEQ ID NO: 860 - protein, 56 aa, Human respiratory syncytial virus
ALATPSAESTSQSTTVKTKNTTTTQIQPSKSTTKQRQNKPPNKPNNDFHFEVFNFV

SEQ ID NO: 861 - protein, 56 aa, Human respiratory syncytial virus
VSTTPSAESTPQSTTVKIKNTTTTQIQPSKPTTKQRQNKPQNKPNNDFHFEVFNFV

SEQ ID NO: 862 - protein, 56 aa, Human respiratory syncytial virus
IGIFNPKYDCKIMTSKTDVSSSVITSLGAIVSCYGKTKCTASNKNRGIIKTFSNGC

SEQ ID NO: 863 - protein, 56 aa, Human respiratory syncytial virus
KPTIKPTNKPTTKTTNKKDPKTPAKTLKKETTTNPTKKLTLKTTERDTSTLQSTVL

SEQ ID NO: 864 - protein, 56 aa, Human respiratory syncytial virus
NFVPCSICGNNQLCKSICKTIPSNKPKKKPTIKPTNKPTTKTTNKRDPKTPAKTTK

SEQ ID NO: 865 - protein, 56 aa, Human respiratory syncytial virus
KRDPKILAKTLKKENTTNPTKKPTPKTTERDTSTSQSIVLDTTTSKHTIQQQSLHS

SEQ ID NO: 866 - protein, 56 aa, Human respiratory syncytial virus
TTKPKEVLTTKPTEKPTINTTKTNIKTTLLTSNTTGNPEHTSQKETLHSTTSEGNP

SEQ ID NO: 867 - protein, 56 aa, Human respiratory syncytial virus
SKPATKQRQNKPPNKPNNDFHFEVFNFVPCSICSNNPTCWAICKRIPSKKPGKKTT

SEQ ID NO: 868 - protein, 56 aa, Human respiratory syncytial virus
CKIMTSKTDVSSSVITSLGAIVSCYGKTKCTASNKNRGIIKTFSNGCDYVSNKGMD

SEQ ID NO: 869 - protein, 56 aa, Human respiratory syncytial virus
GNNQLCKSICKTIPSNKPKKKPTIKPTNKPIIKTTNKKDPKTPTKMPKKETTTNPT

SEQ ID NO: 870 - protein, 56 aa, Human respiratory syncytial virus
KDPKPQTTKPKEVLTTKPTDKPTIINTKTNIKTTLLTTNTTENPEYTSQKETLHST

SEQ ID NO: 871 - protein, 56 aa, Human respiratory syncytial virus
KKPTPKTTERDTSTPQSTVLDTTTSKHTERDTSTSQSIVLDTTTSKHTIQQQSLYS

SEQ ID NO: 872 - protein, 56 aa, Human respiratory syncytial virus
TVLDTTTSKHTERDTSTPPSIVLDTTTSKHTIQQQSPHSTTPENTPNSTQTPTASE

SEQ ID NO: 873 - protein, 38 aa, Human respiratory syncytial virus
TTSKHTIQQQSLHSITPGNTPNSTQTPTASEPSTSNST

SEQ ID NO: 874 - protein, 56 aa, Human respiratory syncytial virus
TKPTRKPTTKITKKDLRPQTTEPREVPTTKPTERSTINTTKTNIRTTLLTNNTTGN

SEQ ID NO: 875 - protein, 56 aa, Human respiratory syncytial virus
SICGNNQLCKSICKTIPSNKPKKKPTIKPTNKPTTKTTNKRGSKTSAKALRKETTT

SEQ ID NO: 876 - protein, 56 aa, Human respiratory syncytial virus
TKKPTIKTTKKDLKPQTTTPKEVPTTSPTEKSTINTTKTNIRTTLLTTNTTGNPEH

SEQ ID NO: 877 - protein, 56 aa, Human respiratory syncytial virus
TKKPTIKTTKKDPKPQTTKPREVLTTKPTEKTTINTTKTNIRTTLLTSNITENQEH

SEQ ID NO: 878 - protein, 56 aa, Human respiratory syncytial virus
KRDPKTPAKMLNKETTTNPTKNLTLKTTERDTSTSQSTVLDTSTSKHIILQQSLHS

SEQ ID NO: 879 - protein, 56 aa, Human respiratory syncytial virus
KRYPKTPAKTLKKEITTNPTKKPTLKTTERDTSTSQSTVLDTTTSKHTILQQSLHS

SEQ ID NO: 880 - protein, 56 aa, Human respiratory syncytial virus
KKPTPKTTESDTSTSQPTVLDTTTLKHTIQQQSLHSTTPENTPNSTQTPTASEPST

SEQ ID NO: 881 - protein, 56 aa, Human respiratory syncytial virus
KIVPKTPAKTPEKEATTNPTKKPTLKITEKDTSTSQSTMLDTTTPNHTIQQQSLHS

SEQ ID NO: 882 - protein, 55 aa, Human respiratory syncytial virus
PTNKPTTKTTNKRDPKTPAKTTKKETTTNPTKNQPSRPQKETPAPHNPLHSTQPH

SEQ ID NO: 883 - protein, 56 aa, Human respiratory syncytial virus
KPGKKTTTKPTKKPTINTTKKDLKPQTTKPKEVLTTKPTEKPTINTTRTNIGTTLL

SEQ ID NO: 884 - protein, 56 aa, Human respiratory syncytial virus
QSTVLDTTPSKHTKGHPALQSIVLDTTTSKHTIQQQSLHSTTPENTPNSTQTPTAS

SEQ ID NO: 885 - protein, 56 aa, Human respiratory syncytial virus
KRSQTSNHKTKGSTYHQAHRKPTINITKPNTRTTLLTNSTTGNLEHTSQEETLHST

SEQ ID NO: 886 - protein, 56 aa, Human respiratory syncytial virus
TKKPTTRTTKKDLKPQTTKPKETLTTKPTEKSTINTTKTNIRTTMLINNTTGNPEN

SEQ ID NO: 887 - protein, 56 aa, Human respiratory syncytial virus
TNSTTISPNTKSKKHHTTAQTKGRTTTSTQTNKPSTKPRPKNPPKKPKDDYHFEVF

SEQ ID NO: 888 - protein, 56 aa, Human respiratory syncytial virus
TKPTEKPTINITKPNIRTTLLTNSTTGNLEHTSQEETFHSTSSEGNTSPSQVYTTS

SEQ ID NO: 889 - protein, 56 aa, Human respiratory syncytial virus
VSFKEDPTPSDNPFSKLYKETIETFDNNEEESSYSYEEINDQTNDNITARLDRIDE

SEQ ID NO: 890 - protein, 56 aa, Human respiratory syncytial virus
QTTKPKEVLTTKPTEKPTINTTKTNIKTTLLTSNTTGNSEHTSQKETLYSTSSEGN

SEQ ID NO: 891 - protein, 56 aa, Human respiratory syncytial virus
GNNQLCKSICKTIPSNKPKKKPTIKPTNKPTTKTTNKRDSKTSAKALRKETTTDPT

SEQ ID NO: 892 - protein, 56 aa, Human respiratory syncytial virus
KKDLKPQTTKPKEAPTTKLTEKPTINISKLNIRTTLLTNSTTGNLEHTSQEETLHS

SEQ ID NO: 893 - protein, 56 aa, Human respiratory syncytial virus
KRDPKTPAKPLKKETTTNPTKKPTPKTTERDTSTSQSTVLDATTSKHTIQQQSLHS

SEQ ID NO: 894 - protein, 40 aa, Human respiratory syncytial virus
FWNTPVKRKPSIQPPPKAIQALHKSIQHPSTYNNLHLHPT

SEQ ID NO: 895 - protein, 55 aa, Human respiratory syncytial virus
ERDTSTSQSTVLDTSTSKHIILQQSLHSTTPENTPNFTQTPTASEPSTSNSTQKT

SEQ ID NO: 896 - protein, 56 aa, Human respiratory syncytial virus
ATISSNTKSETHHTTAQTKGRTTTPTQNNKPSTKPRPKNPPKKPKDDYHFEVFNFV

SEQ ID NO: 897 - protein, 56 aa, Human respiratory syncytial virus
KEIITNPTKKPTLKTTERDTSTSQSTVIDTITPKYTIQQQSLHSTTSENTPSSTQI

SEQ ID NO: 898 - protein, 45 aa, Human respiratory syncytial virus
NKKPGKKTTTKPTKKPTIKTTKKDLKPQTTKPKEVLTTKPTEKPT

SEQ ID NO: 899 - protein, 56 aa, Human respiratory syncytial virus
KPPTKTTNKRDPKTLAKTPKKETTINPTKKPTPKTTERDTSTPQSTVLDTTTSKHT

SEQ ID NO: 900 - protein, 56 aa, Human respiratory syncytial virus
QQTSELHCSPPTSQKIKNTQVKRKPSTQPPPKAIQAPHKSTQHPSTYHNLYLHPTQ

SEQ ID NO: 901 - protein, 56 aa, Human respiratory syncytial virus
GNNQLCKSICKTIPSNKPKKKPTIKPTNKPTTKTTHKRDPKTPAKTTKKETTTNPT

SEQ ID NO: 902 - protein, 56 aa, Human respiratory syncytial virus
AICKRIPSKKPGKNSPTKPTKKPTIKITKNDLKPQTTKPKEAPTTKPTEKPTINTT

SEQ ID NO: 903 - protein, 56 aa, Human respiratory syncytial virus
APSTKPTEKPTINITKPNIRTTLLTNSTTGNLEHTSQEETLHSTSSEGNTSPSQVY

SEQ ID NO: 904 - protein, 56 aa, Human respiratory syncytial virus
KKDLKPQTTKPKEVLTTKPTEKPTINTTKTNIRTTLLTSSTTGNPEQTSQKETLYS

SEQ ID NO: 905 - protein, 42 aa, Human respiratory syncytial virus
KHTIQQQSPHSTTPENTPNSTQTPTASEPSTSNSTQKLQSYA

SEQ ID NO: 906 - protein, 54 aa, Human respiratory syncytial virus
RDTSTPQSTALDTTTSKHTIQQQSLHSTTPENTPNSTQIPTVSEPSTLNGTQKT

SEQ ID NO: 907 - protein, 56 aa, Human respiratory syncytial virus
KKDPKPQTTKPKEVLTPKPTEKPTINTTKTNIRTTLLTSNITENQEHTSQKETLHS

SEQ ID NO: 908 - protein, 56 aa, Human respiratory syncytial virus
KKPTPKTTERDTRTPQSTVLDTTTLKHTERDTSTSQSIALDTTTSKHTIQQQSLYS

SEQ ID NO: 909 - protein, 56 aa, Human respiratory syncytial virus
KRDPKTLAKTPRRETTIDLTGEPAPKTTERDTSTPQSTVLDTATSKHTERDTSTSQ

SEQ ID NO: 910 - protein, 56 aa, Human respiratory syncytial virus
TKPTKKPTIKTTKKDPKPQTTKPKEVLTTKPTEKPTINTTKTNIRTTLLTSNTTGN

SEQ ID NO: 911 - protein, 56 aa, Human respiratory syncytial virus
KPTNFPTIKTTKKDPKPRTTKPREVLTTKPTEKPTINTTKTNIKTTLLTSNTTGNP

SEQ ID NO: 912 - protein, 56 aa, Human respiratory syncytial virus
YMWQQSTLQILCKTIPSNKPKKKPTIKPTNKPPTKTTNKRDPKTLAKTLKKETTTN

SEQ ID NO: 913 - protein, 56 aa, Human respiratory syncytial virus
RTTTKPTKKPTLKTTKKDPKPQTTKSEEVPTTKLTEEPTINTTKTNIITTPLTSNT

SEQ ID NO: 914 - protein, 41 aa, Human respiratory syncytial virus
TTSKHTIQQQFLHSTTPEDTPSSTQTPTASEPSTSNSTQKL

SEQ ID NO: 915 - protein, 56 aa, Human respiratory syncytial virus
KKPTIKPTNKPPTKTTNKRDSKTLAKTLKKETTINPTKKPTPKTTERDTSTSQSTV

SEQ ID NO: 916 - protein, 56 aa, Human respiratory syncytial virus
GTKKDLKPQTIKPKGAPTTKPTEKPTINISKTNITTTLLTNNTTGNLEHTSQEETL

SEQ ID NO: 917 - protein, 56 aa, Human respiratory syncytial virus
PPSPQKNQPMRTPKKISNLTTQNQREALPPSPQKSQPSTSPNQIRELHCSPTVPQE

SEQ ID NO: 918 - protein, 56 aa, Human respiratory syncytial virus
TKPTERSTINTTKTNIRTTLLTNNTTGNPEHTSQKETLHSTSSEGNPSPSQVHTTS

SEQ ID NO: 919 - protein, 56 aa, Human respiratory syncytial virus
KKETTINPTKKPTPKTTERDTSTSQSTVLDTTTSKHTERDTSTSQSIVLDTTTSKH

SEQ ID NO: 920 - protein, 56 aa, Human respiratory syncytial virus
NKKPGKKTTTKPTKKPTINTTKKDPKPQTTKPKEVLTTKPTEKPTINTTRTNIGTT

SEQ ID NO: 921 - protein, 43 aa, Human respiratory syncytial virus
SAIASGIAAPQVLHLEGEVKKFANPLLLQNKVVVSLSNGVRVL

SEQ ID NO: 922 - protein, 56 aa, Human respiratory syncytial virus
LCKSICKTIPSNKPKKKPTIKPTNKPPTKTTNKRDPKTLAKTLKKETTTYPTKKPT

SEQ ID NO: 923 - protein, 53 aa, Human respiratory syncytial virus
ERDTSTSQSIALDTTTSKHTIQQQSLYSTTPENTPNSTQTPTASEPSTSKFHQ

SEQ ID NO: 924 - protein, 56 aa, Human respiratory syncytial virus
PCSICSNNPTCWAICKRIPNKKPRKKTTTKPTKKSTFKTTKKDPKPQTTKSKEVPT

SEQ ID NO: 925 - protein, 56 aa, Human respiratory syncytial virus
LKKETTTNPTKKLTLKTTERDTSTLQSTVLDTTTSKHTTPQQSLHSTTPENTPNFT

SEQ ID NO: 926 - protein, 56 aa, Human respiratory syncytial virus
LDTTTSKHTERDTSTSQSIVLDTTTSKHTIQQQSLHSTTPENTPNSTQTPTASEPS

SEQ ID NO: 927 - protein, 56 aa, Human respiratory syncytial virus
PSGTTSQSTTILASTTPSAESTPQSTTVKIKNTTTTQIQPSKPTTKQRQNKPQNKP

SEQ ID NO: 928 - protein, 56 aa, Human respiratory syncytial virus
PPSPQKSQPSTSPNQIRELHCSPTVPQEFWNTPVKRKPSIQPPPKAIQALHKSIQH

SEQ ID NO: 929 - protein, 56 aa, Human respiratory syncytial virus
TSPKDPKKKDSIISVNSIDIEVTKESPITSNSTIINPTNETDDTVGNKPNYQRKPL

SEQ ID NO: 930 - protein, 56 aa, Human respiratory syncytial virus
TKPTKKPTIKTTKIDLKPQTTKPKEVLTTKPTEKPTINTTRTNIGTTLLTTNTTGN

SEQ ID NO: 931 - protein, 56 aa, Human respiratory syncytial virus
KPIIKTTNKKDPKTPTKMPKKETTTNPTRKPTLKTTERDTSTSQSTELDTTTSKHT

SEQ ID NO: 932 - protein, 56 aa, Human respiratory syncytial virus
AICKRIPNKKPGKKTTTKPTKKPTIKTTKKDPKPQTTKPKEVLTPKPTEKPTINTT

SEQ ID NO: 933 - protein, 56 aa, Human respiratory syncytial virus
KETTTNPTKKPTLTTTERDTSTSQSTVLDTTTLEHTIQQQSLHSTTPENTPNSTQT

SEQ ID NO: 934 - protein, 56 aa, Human respiratory syncytial virus
AICKRIPSKKPGKETTTKPTRKPTIKTTKKDLKPQTTRPKEASTTKPTEKPTINTT

SEQ ID NO: 935 - protein, 56 aa, Human respiratory syncytial virus
KNDLKPQTTKPKEAPTTKPTEKPTINTTKPNIRTTLLTNSTTGNLEYTSQEETLHS

SEQ ID NO: 936 - protein, 56 aa, Human respiratory syncytial virus
TTTNPTKKPTPKTTERDTSTSQSAVLDTTTSKHTIQQQFLHSTTPEDTPSSTQTPT

SEQ ID NO: 937 - protein, 36 aa, Human respiratory syncytial virus
PKYTIQQQSLHSTTSENTPSSTQTPTASEPSTSNPT

SEQ ID NO: 938 - protein, 56 aa, Human respiratory syncytial virus
TILASTTPSIESTLLSTTVKTKNTTTTQLQPSKPTTKQRHNKPPNKPNNDFHFEVF

SEQ ID NO: 939 - protein, 56 aa, Human respiratory syncytial virus
KPTTKTTNKRDSKTSAKALRKETTTDPTKEPTLKTTERDTSTSRSTVLDTTTSDHT

SEQ ID NO: 940 - protein, 56 aa, Human respiratory syncytial virus
SFFNLSGTISQTTAILAPTTPSVEPILQSTTVKTKNTTTTQIQPSKLTTKQRQNKP

SEQ ID NO: 941 - protein, 56 aa, Human respiratory syncytial virus
TTTQIQPSKLTTKQRQNKPPNKPNDDFHFEVFNFVPCSICSNNPTCWAICKRIPSK

SEQ ID NO: 942 - protein, 47 aa, Human respiratory syncytial virus
FIVIDTTTSKHTIRQQSLYSTTLENTPNSTQTPTASEPFTSNSNQKL

SEQ ID NO: 943 - protein, 56 aa, Human respiratory syncytial virus
ERDTSTPQSTVLDTTASKHTERDTSTSQFIVIDTTTSKHTIRQQSLYSTTLENTPN

SEQ ID NO: 944 - protein, 45 aa, Human respiratory syncytial virus
RLRNEESEKMAKDTSDEVSLNPTSEKLNNLLEGNDSDNDLSLEDF

SEQ ID NO: 945 - protein, 56 aa, Human respiratory syncytial virus
KPTIKPTNKPTTKTTNKRDPKTPAKTTKKETTTNPTKKPTLTTTERDTSTSQSTVL

SEQ ID NO: 946 - protein, 56 aa, Human respiratory syncytial virus
VLTTKPTEKPTINTTKTNIRTTLLTTNTTGNPEYTSQKETLHSTSPEGNPSPSQVY

SEQ ID NO: 947 - protein, 56 aa, Human respiratory syncytial virus
ERGTSTSQSTVLDTTISKHTIQQQSLYSTTPENTPNSTQTPAASEPSTSNSTQNLQ

SEQ ID NO: 948 - protein, 56 aa, Human respiratory syncytial virus
KPTTKTTHKRDPKTPAKTTKKETTTNPTKKPTPKTTESDTSTSQPTVLDTTTLKHT

SEQ ID NO: 949 - protein, 56 aa, Human respiratory syncytial virus
AKTLKKETTINPTKKPTPKTTERDTSPSQSTVLDTTPSKHTKGHPALQSIVLDTTT

SEQ ID NO: 950 - protein, 56 aa, Human respiratory syncytial virus
TTKPKEVLTTKPTEKPTINTTKTNIKTTLVTFNTTENPGTHKSKGNPFTQPPSKAI

SEQ ID NO: 951 - protein, 56 aa, Human respiratory syncytial virus
TNSELLSLINDMPITNDQKKLMSNNVQIVRQQSYSIMSIIKEEVLAYVVQLPLYGV

SEQ ID NO: 952 - protein, 56 aa, Human respiratory syncytial virus
KTTTKPTKKPTIKTTKKDLKPQTTKPKEVLTTKPTEKPTINTTKTNIRTTLLTTNT

SEQ ID NO: 953 - protein, 56 aa, Human respiratory syncytial virus
KTTTKPTKKPTIKTTKKDLKPQTTKPKEVLTTKPTEKPTINTTRTNIRTTLLTTNT

SEQ ID NO: 954 - protein, 56 aa, Human respiratory syncytial virus
ERDTSTPQSTVLDTTTSKHTERDTSTSQSTVLNTTTSKHTIQQQSLYSTTPDNTPN

SEQ ID NO: 955 - protein, 56 aa, Human respiratory syncytial virus
KKDFKPQTTKPKEAPTTKPTEKPTINTTKPNIRTTLLTNSTTGNPEHTSQKETPHS

SEQ ID NO: 956 - protein, 56 aa, Human respiratory syncytial virus
TNSATTSPNTKSETHHTTAQTKGRTTTSTQTNKPSTKPRLKNPPKKPKDDYHFEVF

SEQ ID NO: 957 - protein, 56 aa, Human respiratory syncytial virus
AICKRIPNKKPGERTTTKPTKKPTLKTTKKDLKPQTTKSKEAPTTKPTEEPTINTT

SEQ ID NO: 958 - protein, 56 aa, Human respiratory syncytial virus
KTTTKPTKKPTLKTTKKDPKPQTTKSKEVPTTKPTEEPTINTTKTNIITTLLTSNT

SEQ ID NO: 959 - protein, 56 aa, Human respiratory syncytial virus
VPTTKLTEEPTINTTKTNIITTPLTSNTARNPELTSQMETFHSTSSEGNPSPSQVS

SEQ ID NO: 960 - protein, 36 aa, Human respiratory syncytial virus
YKPFTNLYDIRVPITTSISIQHNRPVVIKKRIFKKP

SEQ ID NO: 961 - protein, 56 aa, Human respiratory syncytial virus
MEKFAPEFHGEDANNRATKFLESIKGKFTSPKDPKKKDSIISVNSIDIEVTKESPI

SEQ ID NO: 962 - protein, 56 aa, Human respiratory syncytial virus
KANIKTTLFTSNTTGNPEHTSQKETLHSTTSEGNPSPSQVYTTSEYLSQSLSPSNT

SEQ ID NO: 963 - protein, 56 aa, Human respiratory syncytial virus
LDTTTSKHTERDTSTPQSTVLDTTTSKHTIQQQSLHSTTPENTPNSTQTPTASEPP

SEQ ID NO: 964 - protein, 56 aa, Human respiratory syncytial virus
ESIDANIKSLIPFLCYPITKKGIKTSLSKLKSVVNGDILSYSIAGRNEVFSNKLIN

SEQ ID NO: 965 - protein, 56 aa, Human respiratory syncytial virus
TTPASTTPSTKSTPQSTTVKIKNTTTTQMQPSKPTTKQHQNKPQNKPNNDFHFEVF

SEQ ID NO: 966 - protein, 56 aa, Human respiratory syncytial virus
ICSNNPTCWAICKRIPNKKPGKKTTTKPTKKPTIKTTKKDLKPQTTTPKEVPTTSP

SEQ ID NO: 967 - protein, 56 aa, Human respiratory syncytial virus
TTYLTQVSPERVSPSKQPTTTPPIHTNSATISSNTKSETHHTTAQTKGRTTTPTQN

SEQ ID NO: 968 - protein, 56 aa, Human respiratory syncytial virus
NKKPGKKTTTKPTKKPTIKTTKKDPKPQTTKPKEVLTTKPTEKPTINTTKTNIKTT

SEQ ID NO: 969 - protein, 56 aa, Human respiratory syncytial virus
KPTEKPTINTTKTNIKTTLLTSNTTGNPEHTSQKETLYSTTSEGNPSPSQVYTTSE

SEQ ID NO: 970 - protein, 45 aa, Human respiratory syncytial virus
TGNPENTSQKETLHSTSSEGNPSPPHVYTTSEYPSQPPSPFNTTA

SEQ ID NO: 971 - protein, 47 aa, Human respiratory syncytial virus
TTGNLGRTSQKETLYSTTSEGNPSPSQVYTTSEYLSQSLSPSNTTKW

SEQ ID NO: 972 - protein, 56 aa, Human respiratory syncytial virus
TTSTIASGIIIEKYNVNSLTRGERGPTKPWVGSSTQEKKTMPVYNRQVLTKKQRDQ

SEQ ID NO: 973 - protein, 30 aa, Human respiratory syncytial virus
KPGRKTTTKPTKKQTIKTTKKDLKPQTTKP

SEQ ID NO: 974 - protein, 56 aa, Human respiratory syncytial virus
TKTNIRTTLLTTNTTGNPEHTSQKETLHSTSSEGNPSPSQVYTTSEYLSQPPSTSN

SEQ ID NO: 975 - protein, 56 aa, Human respiratory syncytial virus
KRDPKTPAKALKKETTTNPTKKPTSKTTERDTSTPQSTVLDTTTSGHTIQQQSLHS

SEQ ID NO: 976 - protein, 56 aa, Human respiratory syncytial virus
AICKRIPNKKPGKKTTTKPTKNPTIKTTKKDPKPQTTKPKEVHTTKPTEKPTINTT

SEQ ID NO: 977 - protein, 56 aa, Human respiratory syncytial virus
FIRKSDELLHNVNAGKSTTNIMITTIIIVIIVILLSLIAVGLLLYCKARSTPVTLS

SEQ ID NO: 978 - protein, 56 aa, Human respiratory syncytial virus
KETTTNPTKKLTLKTTERDTSTLQSTVLNTTTSKHTTLQQSLHSTTPENTPNFTQT

SEQ ID NO: 979 - protein, 42 aa, Human respiratory syncytial virus
TTSKHTIQQQSLYSTTPVNKPNSTQTPTASEPSTSNSTQKLQ

SEQ ID NO: 980 - protein, 56 aa, Human respiratory syncytial virus
KKEPKPQTIKPKEVLTTKLTEKPTINTTKANIKTTLFTSNTTGNPEHTSQKETLHS

SEQ ID NO: 981 - protein, 56 aa, Human respiratory syncytial virus
ERDTSTPQSTVLDTATSKHTERDTSTSQSIALDTTTSKYTIQQQSLYSTTLENTPN

SEQ ID NO: 982 - protein, 56 aa, Human respiratory syncytial virus
PTNKPTTKTTNKRGSKTSAKALRKETTTDPTKEPTFKTTERDTSTSRSNVLDTTTS

SEQ ID NO: 983 - protein, 56 aa, Human respiratory syncytial virus
PWVGSSTQEKKTMPVYNRQVLTKKQRDQIDLLAKLDWVYASIDNKDEFMEELSTGT

SEQ ID NO: 984 - protein, 54 aa, Human respiratory syncytial virus
STVLNTTTSKHTIQQQSLYSTTPDNTPNSTQTPTASKPSTSNSTQKLQSYAQLF

SEQ ID NO: 985 - protein, 56 aa, Human respiratory syncytial virus
FYDPLVFPSDEFDASISQVNEKINQSLAFIRKSDELLHNVNAGKSTTNIMITTIII

SEQ ID NO: 986 - protein, 56 aa, Human respiratory syncytial virus
TYLTQVPPERVNSSKQPTTTSPIHTSSATMSPNTGSETHHATAQTRGRITTSTQTN

SEQ ID NO: 987 - protein, 56 aa, Human respiratory syncytial virus
KPTTKPTNKPPTKTTNKRDPKTPAKTLKKETTINPTTKKPTPKTTERDTSTPQSTV

SEQ ID NO: 988 - protein, 55 aa, Human respiratory syncytial virus
EGDTSTSQSTVLDTTASEHTVQQQSLHSTTPENTPNSTQTPTASEPSTSNSTQKP

SEQ ID NO: 989 - protein, 56 aa, Human respiratory syncytial virus
KKDPKPQATKPKGVLTTKPTEGPTINTTKTNIKTALLTSNTTENPEHTSQKETLHS

SEQ ID NO: 990 - protein, 56 aa, Human respiratory syncytial virus
KKDPKPQTTKPKEVHTTKPTEKPTINTTKTNIKTTLLTSNTTGNPENTSQKETLHS

SEQ ID NO: 991 - protein, 56 aa, Human respiratory syncytial virus
KKDPKPQTTKPKEVHTTKPTEKPTINTTKTNIKTTLLTSNTIGNPENTSQKETLHS

SEQ ID NO: 992 - protein, 56 aa, Human respiratory syncytial virus
KKKPTIKPTNKPTTKTTNKKDPKTPAKTLKKETTTNPTKKLTLKTTERDTSTLQST

SEQ ID NO: 993 - protein, 55 aa, Human respiratory syncytial virus
ERDTSTSQSTVLDTTTSKHTILQQSLHSTTPENTPNFTQIPTASEPSTSNSTQEA

SEQ ID NO: 994 - protein, 37 aa, Human respiratory syncytial virus
SKHTIQQQSLHSTTPENTPNSTQTPTASEPSTSLPPE

SEQ ID NO: 995 - protein, 56 aa, Human respiratory syncytial virus
GTITLQSLIAKQYQSNKPKKKPTTKPTNKPPTKTTNKRDPKTLAKTPKKETTINPT

SEQ ID NO: 996 - protein, 56 aa, Human respiratory syncytial virus
TILASTTPGVKSTLQSTTVKTKNTTTTQTQPSKPTTKQRQNKPPSKPNNDFHFEVF

SEQ ID NO: 997 - protein, 56 aa, Human respiratory syncytial virus
CKTIPSNKPKKKPTMKPTNKPTTKTTNKRDPKTPAKTVKKESTTNPTKKPTLKTTE

SEQ ID NO: 998 - protein, 56 aa, Human respiratory syncytial virus
KKDPKPQTKKPKEVLNHQATEKPTLDPTKPNFRTTLLTSNNKGNPEHSSQEETLHF

SEQ ID NO: 999 - protein, 56 aa, Human respiratory syncytial virus
KRDPKTPAKPPKKETTINPTKKPTPKITERDTSTPQSTVLDTTASKHTERDTSTSQ

SEQ ID NO: 1000 - protein, 29 aa, Human respiratory syncytial virus
YNIRVPITTSISIQHNRPVVIKKRIIKKP

SEQ ID NO: 1001 - protein, 56 aa, Human respiratory syncytial virus
TLTTKPTEKSTINATKTNIRTTMPINNTTGNPENTSQKETLHSTSSEGNPSPPHVY

SEQ ID NO: 1002 - protein, 56 aa, Human respiratory syncytial virus
KKDLKPQTTKSKEAPTTKPTEEPTINTTKTNITTTPFTSNTTRNPELTSQMGTFHS

SEQ ID NO: 1003 - protein, 56 aa, Human respiratory syncytial virus
KINQSLAFIRKSDELLHNVNVGKSTTNIMITTIIIVIIVILLLLIAVGLFLYCKAR

SEQ ID NO: 1004 - protein, 56 aa, Human respiratory syncytial virus
WHHQLCESNCKTRPSNKPKKKPTIKPTNKPLTKTTNKRDPKTLAKTPKKETTINPT

SEQ ID NO: 1005 - protein, 56 aa, Human respiratory syncytial virus
FIRRSDELLHNVNTGKSTTNIMITTIIIVIIVVLLSLIAIGLLLYCKAKNTPVTLS

SEQ ID NO: 1006 - protein, 56 aa, Human respiratory syncytial virus
ICSNNPTCWAICKRIPSKKPGKKTTTKPTKKPTIKTTKKDLKPQTTKPKEAPTTKP

SEQ ID NO: 1007 - protein, 56 aa, Human respiratory syncytial virus
KKDLKPQTTKPKEILTTKPTEKPTINTSKTNIRTTLLTTNTTGNSEHTGQKETLHS

SEQ ID NO: 1008 - protein, 56 aa, Human respiratory syncytial virus
TKPKEVLTTKPTDKPTINTTKTNTRTTLLTSNTTGNPEHTSQKETLHSTTSEGNPS

SEQ ID NO: 1009 - protein, 56 aa, Human respiratory syncytial virus
PNNNSGDENSVLTTIIKDDILSAVESNQSYTNSDKNHSVNQNITIKTTLLKKLMCS

SEQ ID NO: 1010 - protein, 56 aa, Human respiratory syncytial virus
TNPTKKPTLKTTERDISTSQSIVLDTITPKYTIQQQSLHSTTSENTPSSTQTPTAS

SEQ ID NO: 1011 - protein, 56 aa, Human respiratory syncytial virus
KKDLKPQTTKPKEILTTKPTEKPTINTTKTNIRTTLLTSNTTGNSEYTSQKETIHS

SEQ ID NO: 1012 - protein, 56 aa, Human respiratory syncytial virus
PKKKPTIKPTNKPPTKTTNKRDPKTLAKTPKKETTINPTKKPTPKTTERDTSTPQS

SEQ ID NO: 1013 - protein, 56 aa, Human respiratory syncytial virus
DYVSNKGVDTVSVGNTLYYVNKQEGKSLYVKGEPIINFYDPLVFPSDEFDASISQV

SEQ ID NO: 1014 - protein, 56 aa, Human respiratory syncytial virus
KRPKNTSQSTEKRNHHQPNKKTNLQDHRKRHQHPTIHCARHDHIGTHNPTAIPPLN

SEQ ID NO: 1015 - protein, 56 aa, Human respiratory syncytial virus
RKPTIKPTNKPPTKTTNKRDPKTLGKTPKKETTINPTKKPTPKTTERDTSNPQSIV

SEQ ID NO: 1016 - protein, 56 aa, Human respiratory syncytial virus
KRPKNTSQNAEKRNHHQPNKKTNPQDHRKRHQHLTIHCARHNHIKTHNPTAIPPLN

SEQ ID NO: 1017 - protein, 56 aa, Human respiratory syncytial virus
KKDLKPQTTKPKEVLTTKPTEKPTINTTKPNIKTTLLTSSTTGNPEHTSQEETLYS

SEQ ID NO: 1018 - protein, 56 aa, Human respiratory syncytial virus
KNITTYLTQVPPERVSSSKQPTTTSPIHTNSATTSPNTKSETHHTTAQTKGRTTTS

SEQ ID NO: 1019 - protein, 56 aa, Human respiratory syncytial virus
PCSICSNNPTCWAICKRIPNKKPGKKTTTKPTRKPTTKITKKDLRPQTTEPREVPT

SEQ ID NO: 1020 - protein, 56 aa, Human respiratory syncytial virus
KKETTIKPTKKPTPKTTERDTSTSQSTVLDTTTLKHQNTQSNSNPSTQPPPKTHPT

SEQ ID NO: 1021 - protein, 56 aa, Human respiratory syncytial virus
RKPTLKTTERDTSTSQSTELDTTTSKHTTQQQSLHSTTSENTPNFTQIPTASEPST

SEQ ID NO: 1022 - protein, 56 aa, Human respiratory syncytial virus
TPKKETTINPTKKPTPKTTERDTSTPQSTVLDTTTSKHTERDTSTPPSIVLDTTTS

SEQ ID NO: 1023 - protein, 56 aa, Human respiratory syncytial virus
ASTTPSVESTLLSTTIKTKNTTTTQIQPSKPTTKQRQNKPPNKPNNDFHFEVFNFV

SEQ ID NO: 1024 - protein, 56 aa, Human respiratory syncytial virus
CSICSNSLTCWALCKRIPNRRPGKKTTTKPTNFPTIKTTKKDPKPRTTKPREVLTT

SEQ ID NO: 1025 - protein, 56 aa, Human respiratory syncytial virus
MSKHKNQRTARTLEKTWDTLNHLIVISSCLYRLNLKSIAQIALSVLAMIISTSLII

SEQ ID NO: 1026 - protein, 56 aa, Human respiratory syncytial virus
YLTQNPQLGISFSNLSETTSQPTTILASTTPSAESTPQSTTVKTKNTTTAQIQPSK

SEQ ID NO: 1027 - protein, 56 aa, Rhinovirus B; identical to SEQ ID NO: 2

SEQ ID NO: 1028 - protein, 56 aa, Rhinovirus B
QTVALTEGLGDELEEVIVEKTKQTVASISSGPKHTQKVPILTANETGATMPVLPSD

SEQ ID NO: 1029 - protein, 56 aa, Rhinovirus B
QTEALMEGFEGELEEVVIDKMKQVTASSQSGPKYTQKVPALSANETGATLPTNPSD

SEQ ID NO: 1030 - protein, 56 aa, Rhinovirus B
TGQVHLLSFISACPDFKLRLMKDTQTISQTDALTEGLGDELEEVIVEKTKQTLASV

SEQ ID NO: 1031 - protein, 56 aa, Rhinovirus B
SSGPKHTQSVPALTANETGATLPTRPSDNVETRTTYMHFNGSETDVESFLGRAACV

SEQ ID NO: 1032 - protein, 56 aa, Rhinovirus B
QSGPKYTQKVPALSANETGATLPTNPSDNVETRTTYMHFTGSETSLENFLGRSACV

SEQ ID NO: 1033 - protein, 56 aa, Rhinovirus B
RAKHVEAWIPRAPRALPYETIGRTNYPKKSEIVPVIKKRSTITTYGLGSRYGGVFT

SEQ ID NO: 1034 - protein, 56 aa, Rhinovirus B
SSGPKHTQKVPILTANETGATMPVLPSDSIETRTTYMHFNGSETDVECFLGRAACV

SEQ ID NO: 1035 - protein, 56 aa, Rhinovirus B
QTDALTEGLGDELEEVIVEKTKQTLASVSSGPKHTQSVPTLTANETGATMPTNPSD

SEQ ID NO: 1036 - protein, 56 aa, Rhinovirus B
FQGPVYKDLEIDVCNTPPPECINDLLKSVDSEEVREYCKKKKWIIPQVPTNIERAM

SEQ ID NO: 1037 - protein, 56 aa, Rhinovirus B
TGQVYLLSFISACPDFKLRLMKDTQTISQTVALTEGLGDELEEVIVEKTKQTVASI

SEQ ID NO: 1038 - protein, 56 aa, Rhinovirus B
QLKKQYFVEKQGQVIARHKVREFNINPVNTPTKSKLHPSVFYDVFPGDKEPAVLSD

SEQ ID NO: 1039 - protein, 56 aa, Rhinovirus B
SGQVYLLSFISACPDFKLRLMKDTQTISQTDALTEGLSDELEEVIVEKTKQTLASV

SEQ ID NO: 1040 - protein, 56 aa, Rhinovirus B
PEHQLASHTQGNVSVKYKYTHPGEQGIDLDSVAETGGASHDPVYSMNGTLIGNLLI

SEQ ID NO: 1041 - protein, 56 aa, Rhinovirus B
VINYYKDAASSSSAGQSFSMDPSKFTEPVKDLMLKGAPALNSPNVEACGYSDRVQQ

SEQ ID NO: 1042 - protein, 56 aa, Rhinovirus B; identical to SEQ ID NO: 1041

SEQ ID NO: 1043 - protein, 56 aa, Rhinovirus B
INTPTKSKLHPSVFYNVFPGSKEPAVLSDNDPRLEVKLSDSLFSKYKGNIEMKPTE

SEQ ID NO: 1044 - protein, 56 aa, Rhinovirus B
PEHQLASHEGGTVSVKYKYTHPGDRGIDLDTVEVAGGPTSDAIYNMDGTLLGNLLI

SEQ ID NO: 1045 - protein, 56 aa, Rhinovirus B
VINYYKDAASTSSAGQSLSMDPSKFTEPVKDLMLKGAPALNSPNVEACGYSDRVQQ

SEQ ID NO: 1046 - protein, 56 aa, Rhinovirus B
PEHQLASHKGGNVSVKYKYTHPGESGIDLSTQLDEDGPVKDPVYSMNGTLLGNLLI

SEQ ID NO: 1047 - protein, 56 aa, Rhinovirus B
NTPTKSKLHPSVFYDVFPGDKEPAVLSDNDPRLEVKLTESLFSKYKGNVNTEPTEN

SEQ ID NO: 1048 - protein, 56 aa, Rhinovirus B
ELGLKPINTPTKTKLHPSVFYEIFPGSKEPAALNDSDPRLEVNLRDSLFSKYKGNV

SEQ ID NO: 1049 - protein, 56 aa, Rhinovirus B
AQLRKQYFIEKQGQIISRQKVRELNMASINTPTKSKLHPSVFYNVFPGSKEPAVLS

SEQ ID NO: 1050 - protein, 56 aa, Rhinovirus B
KSEIVPVIKKRSTITTYGLGSRYGGVFTSNVKIMNYHLMTPEDHLNLITPYVNRDL

SEQ ID NO: 1051 - protein, 56 aa, Rhinovirus B
VINYYKDAASSSSAGQSFSMDPSKFTEPVKDIMLKGAPALNSPNVEACGYSDRVQQ

SEQ ID NO: 1052 - protein, 56 aa, Rhinovirus B
VYSLPPDPKHFDGYQQQEVVIMDDLNQNPDGQDVSMFCQMVSSVDFIPPMASLDNK

SEQ ID NO: 1053 - protein, 56 aa, Rhinovirus B
LIHGSPGSGKSLTTSIVGRAIAERFKSTVYSLPPDPKHFDGYQQQEVVIMDDLNQN

SEQ ID NO: 1054 - protein, 56 aa, Rhinovirus B
TAGGSGYVCFADIRQLDCIAEEQGLNDYITNLGRAFGVGFTDQISAKVTELQDVAK

SEQ ID NO: 1055 - protein, 56 aa, Rhinovirus B
QGPVYKDLEIDVCNTPPPECINDLLKSVDSEEIREYCKKKKWIIPEIPTNIERAMN

SEQ ID NO: 1056 - protein, 56 aa, Rhinovirus B
DSLEILFQGPVYKDLEIDVHNTPPPECISDLLKSVDSEELREYCKQKNWLIPEIPT

SEQ ID NO: 1057 - protein, 56 aa, Rhinovirus B
DILNRETRDVEKMKFYLDKYGIDLPLVTYIKDELRSTDKVRLGKSRLIEASSLNDS

SEQ ID NO: 1058 - protein, 56 aa, Rhinovirus B
MGAQVSTQKSGSHENQNILTNGSNQTFTVINYYKDAASSSSAGQSFSMDPSKFTEP

SEQ ID NO: 1059 - protein, 56 aa, Rhinovirus B
DPKHFDGYQQQEVVIMDDLNQNPDGQDISMFCQMVSSVDFIPPMANLDNKGMLFTS

SEQ ID NO: 1060 - protein, 56 aa, Rhinovirus B
NTEPVIKKRKGDIKSYGLGPRYGGIYTSNVKIMNYHLMTPEDHHNLIAPYPNRDLA

SEQ ID NO: 1061 - protein, 56 aa, Rhinovirus B
SGKSLTTSIVGRAIAEHFNSAVYSLPPDPKHFDGYQQQEVVIMDDLNQNPDGQDIS

SEQ ID NO: 1062 - protein, 56 aa, Rhinovirus B
GRQGFSAQLRKQYFVEKQGAIINKRNVKELGLKPINTPTKTKLHPSVFYEIFPGSK

SEQ ID NO: 1063 - protein, 56 aa, Rhinovirus B
MGAQVSTQKSGSHENQNILTNGSNQTFTVINYYKDAASTSSAGQSLSMDPSKFTEP

SEQ ID NO: 1064 - protein, 56 aa, Rhinovirus B
LGIKKRDILNRDTQDVTKMEHYLDKYGIDLPLVTYIKDELRSKDKVRLGKSRLIEA

SEQ ID NO: 1065 - protein, 56 aa, Rhinovirus B
GSGKSLTTSIVGRALAEYFNSSVYSLPPDPKHFDGYQQQEVVIMDDLNQNPDGQDI

SEQ ID NO: 1066 - protein, 56 aa, Rhinovirus B
PKHFDGYQQQEVVIMDDLNQNPDGQDISMFCQMVSSVDFLPPMASLDNKGMLFTSN

SEQ ID NO: 1067 - protein, 56 aa, Rhinovirus B; identical to SEQ ID NO: 1058

SEQ ID NO: 1068 - protein, 56 aa, Rhinovirus B
LYGVDGLEPIDITTSAGYPYVSLGIKKRDILNRETRDVEKMKFYLDKYGIDLPLVT

SEQ ID NO: 1069 - protein, 56 aa, Rhinovirus B
RAKHVEAWIPRAPRALPYTSIGRTNYPKNTEPVIKKRKGDIKSYGLGPRYGGIYTS

SEQ ID NO: 1070 - protein, 56 aa, Rhinovirus B
AGGSGYVCFADIRQLECIAEEQGLSDYITGLGRAFGVGFTDQISTKVTELQEVAKD

SEQ ID NO: 1071 - protein, 56 aa, Rhinovirus B
SSGPKHTQSVPTLTANETGATMPTNPSDNVETRTTYMHFNGSETDVESFLGRAACV

SEQ ID NO: 1072 - protein, 56 aa, Rhinovirus B
YGVDGLEPIDITTSAGFPYVSLGIKKRDILNKETQDTEKMKFYLDKYGIDLPLVTY

SEQ ID NO: 1073 - protein, 56 aa, Rhinovirus B
VDSEEVREYCKKKKWIIPQVPTNIERAMNQASMIINTILMFVSTLGIVYVIYKLFA

SEQ ID NO: 1074 - protein, 56 aa, Rhinovirus B
DSEEIREYCKKKKWIIPEIPTNIERAMNQASMIINTILMFVSTLGIVYVIYKLFAQ

SEQ ID NO: 1075 - protein, 56 aa, Rhinovirus B
VKDLMLKGAPALNSPNVEACGYSDRVQQITLGNSTITTQEAANAVVCYAEWPEYLP

SEQ ID NO: 1076 - protein, 56 aa, Rhinovirus B
VKDIMLKGAPALNSPNVEACGYSDRVQQITLGNSTITTQEAANAVVAYAEWPSYLA

SEQ ID NO: 1077 - protein, 56 aa, Rhinovirus B
EQFPFLVHPVMPMQDIYESIRWTKDPRNTQDHVRSLCMLAWHSGEKDYNDFTQRIR

SEQ ID NO: 1078 - protein, 56 aa, Rhinovirus B
LNHMGSMAFRIVNEHDEHKTLVKIRVYHRAKHVEAWIPRAPRALPYTSIGRTNYPK

SEQ ID NO: 1079 - protein, 56 aa, Rhinovirus B
ILNKETQDTEKMKFYLDKYGIDLPLVTYIKDELRSVDKVRLGKSRLIEASSLNDSV

SEQ ID NO: 1080 - protein, 56 aa, Rhinovirus B
SDLLKSVDSEELREYCKQKNWLIPEIPTNIERAVNQASTIINTILMFVSTLGILYV

SEQ ID NO: 1081 - protein, 56 aa, Rhinovirus B
IKDELRSVDKVRLGKSRLIEASSLNDSVNMRMKLGNLYKAFHQNPGVLTGSAVGCD

SEQ ID NO: 1082 - protein, 56 aa, Rhinovirus B
MGAQVSTQRSGSHENQNILTNGSTQHFTVINYYKDAASSSSAGQSFSMDPSKFTEP

SEQ ID NO: 1083 - protein, 56 aa, Rhinovirus B
TTPGSGQFLTTDDRQSPSAMPNYEPTPLIHIPGEVHNLLEIIQVDTLIPMNNKGAT

SEQ ID NO: 1084 - protein, 56 aa, Rhinovirus B
EIDITENMQIAIDQYSGQLLSLDIPTDELSLKEALYGTDGLEPIDINTSAGYPYVS

SEQ ID NO: 1085 - protein, 56 aa, Rhinovirus B
VTVTIAPMYTEFSGIRSKAVVPQGLPTLTTPGSGQFLTTDDRQSPSAMPNYEPTPL

SEQ ID NO: 1086 - protein, 56 aa, Rhinovirus B
TLPGSGQFLTTDDRQSPSALPNYEPTPRIHIPGKVHNLLEIIQVDTLIPMNNTHTK

SEQ ID NO: 1087 - protein, 56 aa, Rhinovirus B
EKLDFCKRLKQLDILERQIATMHVSNPTQEKREQLFNNVLWLEQMSQKFAPLYAVE

SEQ ID NO: 1088 - protein, 56 aa, Rhinovirus B
LSLKEALYGTDGLEPIDINTSAGYPYVSLGIKKRDILNRDTQDVTKMEHYLDKYGI

SEQ ID NO: 1089 - protein, 56 aa, Rhinovirus B
YIKDELRSTDKVRLGKSRLIEASSLNDSVNMRMKLGNLYKAFHQNPGIITGSAVGC

SEQ ID NO: 1090 - protein, 56 aa, Rhinovirus B
VTVTIAPMCTEFTGIRSRSIVPQGLPTTTLPGSGQFLTTDDRQSPSALPSYEPTPR

SEQ ID NO: 1091 - protein, 56 aa, Rhinovirus B
EPAALNDSDPRLEVNLRDSLFSKYKGNVEIDITENMQIAIDQYSGQLLSLDIPTDE

SEQ ID NO: 1092 - protein, 56 aa, Rhinovirus B
TLPGSGQFLTTDDRQSPSALPSYEPTPRIHIPGKVRNLLEIIQVGTLIPMNNTGTN

SEQ ID NO: 1093 - protein, 56 aa, Rhinovirus B
KKYGLTITPPDKSEKFVKTTWENVTFLKRYFRPDPQYPFLIHPVMPMQDIHESIRW

SEQ ID NO: 1094 - protein, 56 aa, Rhinovirus B
DLPLVTYIKDELRSKDKVRLGKSRLIEASSLNDSVNMRVKLGNLYKAFHTNPGVIT

SEQ ID NO: 1095 - protein, 56 aa, Rhinovirus B
NVKIMNYHLMTPEDHHNLIAPYPNRDLAIVSTGGHGAETIPHCNCTSGVYYSTYYR

SEQ ID NO: 1096 - protein, 56 aa, Rhinovirus B
MLVAVDHYAGQLLSLDIPTSELTLKEALYGVDGLEPIDITTSAGFPYVSLGIKKRD

SEQ ID NO: 1097 - protein, 56 aa, Rhinovirus B
SNVKIMNYHLMTPEDHLNLITPYVNRDLAVVFTGAHGAETIPHCSCTSGVYYSRYY

SEQ ID NO: 1098 - protein, 56 aa, Rhinovirus B
KLKVIAYGDDLIVSYPFELQPELLALAGKKYGLTITPPDKSEKFVKTTWENVTFLK

SEQ ID NO: 1099 - protein, 56 aa, Rhinovirus B
ASQPEASSYSSNLTVQAMYVPPGAPNPKEWDDYTWQSASNPSVFFKVGETSRFSVP

SEQ ID NO: 1100 - protein, 56 aa, Rhinovirus B
NVETRTTYMHFNGSETDVESFLGRAACVHVTEIKNKNAAGLDNHRKEGLFNDWKIN

SEQ ID NO: 1101 - protein, 56 aa, Rhinovirus B
YGDDLIVSYPYELDPEVLATLGKKYGLTITPPDKTEKFSKITWDNLTFLKRYFRSD

SEQ ID NO: 1102 - protein, 56 aa, Rhinovirus B
LNHMGSMAFRVVNEHDVHTTIVKIRVYHRAKHVEAWIPRAPRALPYVSIGRTNYPR

SEQ ID NO: 1103 - protein, 56 aa, Rhinovirus B
KNKMVNYMQFKSKQRIEPVCVLIHGTPGSGKSLTTSIVGRAIAEHFNSAVYSLPPD

SEQ ID NO: 1104 - protein, 56 aa, Rhinovirus B
NDPRLEVKLTESLFSKYKGNVNTEPTENMLVAVDHYAGQLLSLDIPTSELTLKEAL

SEQ ID NO: 1105 - protein, 56 aa, Rhinovirus B
PSRFQSGVMKGVGPAEPGDCGGILRCVHGPIGLLTAGGSGYVCFADIRQLDFIAET

SEQ ID NO: 1106 - protein, 56 aa, Rhinovirus B
NMLIAVDHYAGQLMSLDIPTEELTLKEALYGVDGLEPIDITTSAGYPYVSLGIKKR

SEQ ID NO: 1107 - protein, 56 aa, Rhinovirus B
YEYPTRTGQCGGVLCSTGKIYGIHVGGNGRQGFSAQLRKQYFVEKQGAIINKRNVK

SEQ ID NO: 1108 - protein, 36 aa, Human herpesvirus 5; identical to SEQ ID NO: 3

SEQ ID NO: 1109 - protein, 56 aa, Human herpesvirus 5
QTPVNGNSPWAPTAPLPGDMNPANWPRERAWALKNPHLAYNPFRMPTTSTASQNTV

SEQ ID NO: 1110 - protein, 56 aa, Human herpesvirus 5
SPLSMLSSASPSPAKSAPPSPVKGRGSRVGVPSLKPTLGGKAVVGRPPSVPVSGSA

SEQ ID NO: 1111 - protein, 40 aa, Human herpesvirus 5
PQKSGTGPQPGSAGMGGAKTPSDAVQNILQKIEKIKNTEE

SEQ ID NO: 1112 - protein, 56 aa, Human herpesvirus 5
RIRKAKLSSPMTTTSTSQKPVLGKRVATPHASARAQTVTSTPVQGRLEKQVSGTPS

SEQ ID NO: 1113 - protein, 44 aa, Human herpesvirus 5
SVKYQALATASGEEVAVLSHHDSLESRRLREEEDDDDDEDFEDA

SEQ ID NO: 1114 - protein, 55 aa, Human herpesvirus 5
SHATSSAHNGSHTSRTTSAQTRSVSSQHVTSSEAVSHRANETIYNTTLKYGDVVG

SEQ ID NO: 1115 - protein, 56 aa, Human herpesvirus 5
KKKPSKHHHHQQSSIMQETDDLDEEDTSIYLSPPPVPPVQVVAKRLPRPDTPRTPR

SEQ ID NO: 1116 - protein, 39 aa, Human herpesvirus 5
KTTHAYTNAAFTSSDATLPMGTTGSYTPPQDGSFPPPPR

SEQ ID NO: 1117 - protein, 56 aa, Human herpesvirus 5
RAWALKNPHLAYNPFRMPTTSTASQNTVSTTPRRPSTPRAAVTQTASRDAADEVWA

SEQ ID NO: 1118 - protein, 56 aa, Human herpesvirus 5
VGVPSLKPTLGGKAVVGRPPSVPVSGSAPGRLSGSSRAASTTPTYPAVTTVYPPSS

SEQ ID NO: 1119 - protein, 56 aa, Human herpesvirus 5
LKAWEERQQNLQQRQQQPPPPARKPSASRRLFGSSADEDDDDDDDEKNIFTPIKKP

SEQ ID NO: 1120 - protein, 56 aa, Human herpesvirus 5
RRSTGTAAVGSPVKSTTGMKTVAFDLSSPQKSGTGPQPGSAGMGGAKTPSDAVQNI

SEQ ID NO: 1121 - protein, 56 aa, Human herpesvirus 5
PGRLSGSSRAASTTPTYPAVTTVYPPSSTAKSSVSNAPPVASPSILKPGASAALQS

SEQ ID NO: 1122 - protein, 56 aa, Human herpesvirus 5
TAKSSVSNAPPVASPSILKPGASAALQSRRSTGTAAVGSPVKSTTGMKTVAFDLSS

SEQ ID NO: 1123 - protein, 56 aa, Human herpesvirus 5
TSAQTRSVSSQHVTSSEAVSHRANETIYNTTLKYGDVVGVNTTKYPYRVCSMAQGT

SEQ ID NO: 1124 - protein, 56 aa, Human herpesvirus 5
RGTSATHSHHSSHTTSAAHSRSGSVSQRVTSSQTVSHGVNETIYNTTLKYGDVVGV

SEQ ID NO: 1125 - protein, 56 aa, Human herpesvirus 5
SGSVSHHVTSSQTVSHDVNETIYNTTLKYGDVVGVNTTKYPYRVCSMAQGTDLIRF

SEQ ID NO: 1126 - protein, 49 aa, Human herpesvirus 5
TVSHGVNETIYNTTLKYGDVVGVNTTKYPYRVCSMAQGTDLIRFERNIV

SEQ ID NO: 1127 - protein, 56 aa, Human herpesvirus 5
GTSATHSHHSSHTTSAAHSRSGSVSSQRVTSSEAVSHRANETIYNTTLKYGDVVGV

SEQ ID NO: 1128 - protein, 39 aa, Human herpesvirus 5
LDGQTGTQDKGQKPNLLDRLRHRKNGYRHLKDSDEEENV

SEQ ID NO: 1129 - protein, 53 aa, Human herpesvirus 5
DLMRHSPDVPREAVMSPTMVTIPPPQIPFVGSARELRGVKKKKPTAAALLSSA

SEQ ID NO: 1130 - protein, 56 aa, Human herpesvirus 5
PHASARAQTVTSTPVQGRLEKQVSGTPSTVPATLLQPQPASSKTTSSRNVTSGAGT

SEQ ID NO: 1131 - protein, 56 aa, Human herpesvirus 5
GTSGKGAASGGGVSSIFSGLLSSGSQKPTSGPLNIPQQQQRHAAFSLVSPQVTKAS

SEQ ID NO: 1132 - protein, 56 aa, Human herpesvirus 5
TNEQAYQMLLALVRLDAEQRAQQNGTDSLDGQTGTQDKGQKPNLLDRLRHRKNGYR

SEQ ID NO: 1133 - protein, 56 aa, Human herpesvirus 5
SYEESVYNSGRKGPGPPSSDASTAAPPYTNEQAYQMLLALVRLDAEQRAQQNGTDS

SEQ ID NO: 1134 - protein, 56 aa, Human herpesvirus 5
THNGSHTSRTTSAQTRSVSSQHVTSSEAVSHRANETIYNTTLKSGDVVGVNTTKYP

SEQ ID NO: 1135 - protein, 56 aa, Human herpesvirus 5
LGHTTPSSDYNNDVISPPSQTPEQSTPSRIRKAKLSSPMTTTSTSQKPVLGKRVAT

SEQ ID NO: 1136 - protein, 34 aa, Human herpesvirus 5
YTNAAFTSSDATLPMGTTGLYTPPQDGSFPPPPR

SEQ ID NO: 1137 - protein, 56 aa, Human herpesvirus 5
PLTIESHLSDNEEDPIRYYVSVYDELTASEMEEPSNSTSWQIPKLMKVATQPVSLR

SEQ ID NO: 1138 - protein, 55 aa, Human herpesvirus 5
VRKVCSCCGNSSESESKATHAYTNAAFTSSDATLPMGTTGSYTPPQDGSFPPPPR

SEQ ID NO: 1139 - protein, 56 aa, Human herpesvirus 5
VTQTASRDAADEVWALRDQTAESPVEDSEEEDDSSDTGSVVSLGHTTPSSDYNNDV

SEQ ID NO: 1140 - protein, 56 aa, Human herpesvirus 5
TSGPLNIPQQQQRHAAFSLVSPQVTKASPGRVRRDSAWDVRPLTETRGDLFSGDED

SEQ ID NO: 1141 - protein, 56 aa, Human herpesvirus 5
SDSSDGYPPNRQDPRFTDTLVDITDTETSAKPPVTTAYKFEQPTLTFGAGVNVPAG

SEQ ID NO: 1142 - protein, 50 aa, Human herpesvirus 5
IYLSPPPVPPVQVVAKRLPRPDTPRTPRQKKISQRPPTPGTKKPAASLPF

SEQ ID NO: 1143 - protein, 35 aa, Human herpesvirus 5
AYTNAAFTSSDATLPMGTTGSYTPPQDGSFPPPPR

SEQ ID NO: 1144 - protein, 56 aa, Human herpesvirus 5
STTPRRPSTPRAAVTQTASRDAADEVWALRDQTAESPVEDSEEEDDDSSDTGSVVS

SEQ ID NO: 1145 - protein, 56 aa, Human herpesvirus 5
RRLFGSSADEDDDDDDDEKNIFTPIKKPGTSGKGAASGGGVSSIFSGLLSSGSQKP

SEQ ID NO: 1146 - protein, 56 aa, Human herpesvirus 5
THDGSKKNAVRSTFREDKAPKPSKQSKKKKKPSKHHHHQQSSIMQETDDLDEEDTS

SEQ ID NO: 1147 - protein, 56 aa, Human herpesvirus 5
PFRMPTTSTASQNTVSTTPRRPSTPRAAVTQTASRDAADEVWALRDQTAESPVEDS

SEQ ID NO: 1148 - protein, 30 aa, Human herpesvirus 5
MLSGPRWISLSDGAPLDNGTLTAASTTGKS

SEQ ID NO: 1149 - protein, 56 aa, Human herpesvirus 5
SFVNPNYGRGSPLTIESHLSDNEEDPIRYYVSVYDELTASEMEEPSNSTSWQIPKL

SEQ ID NO: 1150 - protein, 56 aa, Human herpesvirus 5
AGAAILTPTPVNPSTAPAPAPTPTFAGTQTPVNGNSPWAPTAPLPGDMNPANWPRE

SEQ ID NO: 1151 - protein, 56 aa, Human herpesvirus 5
MESSAKRKMDPDNPDEGPSSKVPRPETPVTKATTFLQTMLRKEVNSQLSLGDPLFP

SEQ ID NO: 1152 - protein, 56 aa, Human herpesvirus 5
DTSFVNPNYGRGSPLTIESHLSDNEEDPIRYYVSVYDELTASEMEEPSNSTSWQIP

SEQ ID NO: 1153 - protein, 56 aa, Human herpesvirus 5
SAKPPVTTAYKFEQPTLTFGAGVNVPAGAGAAILTPTPVNPSTAPAPAPTPTFAGT

SEQ ID NO: 1154 - protein, 56 aa, Human herpesvirus 5
AQGDDDVWTSGSDSDEELVTTERKTPRVTGGGAMAGASTSAGRKRKSASSATACTS

SEQ ID NO: 1155 - protein, 44 aa, Human herpesvirus 5
YYVSVYDELTASEMEEPSNSTSWQIPKLMKVATQPVSLRDPEYD

SEQ ID NO: 1156 - protein, 56 aa, Human herpesvirus 5
LTVTYSSHTTSAAHSRSGSVSQRVTSSQTVSHGVNETIYNTTLKYGDVVGVNTTKY

SEQ ID NO: 1157 - protein, 56 aa, Human herpesvirus 5
VTKATTFLQTMLRKEVNSQLSLGDPLFPELAEESLKTFEQVTEDCNENPEKDVLAE

SEQ ID NO: 1158 - protein, 56 aa, Human herpesvirus 5
NEERQQKLRLCGSGCGGNDSSSGSHREATHDGSKKNAVRSTFREDKAPKPSKQSKK

SEQ ID NO: 1159 - protein, 56 aa, Human herpesvirus 5
PGRVRRDSAWDVRPLTETRGDLFSGDEDSDSSDGYPPNRQDPRFTDTLVDITDTET

SEQ ID NO: 1160 - protein, 56 aa, Human herpesvirus 5
VTSSQTVSHGVNETIYNTTLKYGDVVGVNTTKYPYRVCSMAQGTDLIRFERNIVCT

SEQ ID NO: 1161 - protein, 56 aa, Human herpesvirus 5
EVDQCLAYRSLTRKKLEQHAAKKQNIYERIPYRPSRQKDNSPLIEPTGTDDEEDED

SEQ ID NO: 1162 - protein, 56 aa, Human herpesvirus 5
AASEALDPHAFHLLLNTYGRPIRFLRENTTQCTYNSSLRNSTVVRENAISFNFFQS

SEQ ID NO: 1163 - protein, 54 aa, Human herpesvirus 5
RKICSCCGNSSESESKTTHAYTNAAFTSSDATLPMGTTGSYTPPQDGSFPPPPR

SEQ ID NO: 1164 - protein, 54 aa, Human herpesvirus 5
LRVFACCCVKQEIPYQDIDIELQKDIQRRAKHTKRTHYDRKNAPMESGEEEFLL

SEQ ID NO: 1165 - protein, 56 aa, Human herpesvirus 5
EEDEVTVMSPSPEPVQQQPPVEPVQQQPQGRGSHRRRYKESAPQETLPTNHEREIL

SEQ ID NO: 1166 - protein, 54 aa, Human herpesvirus 5
VTKATTFLQTMLRKEVNSQLSLGDPLFPELAEESLKTFERVTEDCNENPEKDCG

SEQ ID NO: 1167 - protein, 49 aa, Human herpesvirus 5
GFMLPIYETATKAYAVGQFEQPTETPPEDLDTLSLAIEAAIQDLRNKSQ

SEQ ID NO: 1168 - protein, 56 aa, Human herpesvirus 5
YVASRNGLFAVENFLTEEPFQRGDPFDKNYVGNSGKSRGGGGGGGSLSSLANAGGL

SEQ ID NO: 1169 - protein, 34 aa, Human herpesvirus 5
TLLLMLSGPRWISLSDGAPLDNGTLTAASTTGKS

SEQ ID NO: 1170 - protein, 56 aa, Human herpesvirus 5
LSPRKKPRKTTRPFKVIIKPPVPPAPIMLPLIKQEDIKPEPDFTIQYRNKIIDTAG

SEQ ID NO: 1171 - protein, 56 aa, Human herpesvirus 5
SSSSTTGSRGTSTHNHHSSHTTSAARSQSGSVSHHVTSSQTVSHDVNETIYNTTLK

SEQ ID NO: 1172 - protein, 56 aa, Human herpesvirus 5
DSANGLLRDPRLMNRQKERRPPPSSENDGSPPLREAKRQKTTAQHEGHGGGGKNET

SEQ ID NO: 1173 - protein, 56 aa, Human herpesvirus 5
TGGGAMAGASTSAGRKRKSASSATACTSGVMTRGRLKAESTVAPEEDTDEDSDNEI

SEQ ID NO: 1174 - protein, 56 aa, Human herpesvirus 5
KTPDPMIMFDEDDDDELSLPRNVMTHEEAESRLYDAITENLMHCVKLVTTDSPLAT

SEQ ID NO: 1175 - protein, 56 aa, Human herpesvirus 5
VTKATTFLQTMLRKEVNSQLSLGDPLFPELAEESLKTFERVTEDCNENPEKDVLAE

SEQ ID NO: 1176 - protein, 56 aa, Human herpesvirus 5
SSAPLNKPTPTSVAVTNTPLPGASATPELSPRKKPRKTTRPFKVIIKPPVPPAPIM

SEQ ID NO: 1177 - protein, 56 aa, Human herpesvirus 5
ATNVTSSTKVPTSTSSRNSVDNATSSGPTTGINMTTTHESSVHSVRNDEIMKVLAI

SEQ ID NO: 1178 - protein, 56 aa, Human herpesvirus 5; identical to SEQ ID NO: 1157

SEQ ID NO: 1179 - protein, 56 aa, Human herpesvirus 5; identical to SEQ ID NO: 1151

SEQ ID NO: 1180 - protein, 56 aa, Human herpesvirus 5
VCLGAAVSSSSTSHATSSAHNGSHTSRTTSAQTRSVSSQHVTSSEAVSHRANETIY

SEQ ID NO: 1181 - protein, 56 aa, Human herpesvirus 5
PADEEAEDSVFTSTRARSATEDLDRMEAGLSPYSVSSDAPSSFELVRETGGTGAAK

SEQ ID NO: 1182 - protein, 48 aa, Human herpesvirus 5
FMLPIYETAAKAYAVGQFEQPTETPPEDLDTLSLAIEAAIQDLRNKSQ

SEQ ID NO: 1183 - protein, 56 aa, Human herpesvirus 5
KTPTCQHPKKTPDPMIMFDEDDDDELSLPRNVMTHEEAESRLYDAITENLMHCVKL

SEQ ID NO: 1184 - protein, 56 aa, Human herpesvirus 5; identical to SEQ ID NO: 1151

SEQ ID NO: 1185 - protein, 56 aa, Human herpesvirus 5
LLSAALPSAASSSPTTTTVCTPTGELTSGGGETPTALLSGGAKVAERAQAGVVNAS

SEQ ID NO: 1186 - protein, 56 aa, Human herpesvirus 5
TVPATLLQPQPASSKTTSSRNVTSGAGTSSASSARQPSASASVLSPTEDDVVSPAT

SEQ ID NO: 1187 - protein, 56 aa, Human herpesvirus 5
PELSPRKKPRKTTRPFKVIIKPPVPPAPIMLPLIKQEDIKPEPDFTIQYRNKIIDT

SEQ ID NO: 1188 - protein, 56 aa, Human herpesvirus 5
LVRKICSCCGNSSESESKTTHAYTNAAFTSSDATLPMGTTGSYTPPQDGSFPPPPR

SEQ ID NO: 1189 - protein, 35 aa, Human herpesvirus 5
RTPMPHSLLPTRRYPWALPGSYTPPQDGSFPPPPR

SEQ ID NO: 1190 - protein, 56 aa, Human herpesvirus 5
EHPTFTSQYRIQGKLEYRHTWDRHDEGAAQGDDDVWTSGSDSDEELVTTERKTPRV

SEQ ID NO: 1191 - protein, 56 aa, Human herpesvirus 5
VTSSEAVSHRANETIYNTTLKYGDVVGVNTTKYPYRVCSMAQGTDLIRFERNIVCT

SEQ ID NO: 1192 - protein, 56 aa, Human herpesvirus 5
MSSRRRSSSRRSGEPSTVIYIPSSNEDTPADEEAEDSVFTSTRARSATEDLDRMEA

SEQ ID NO: 1193 - protein, 56 aa, Human herpesvirus 5
EPAPSLHPSYPVPPPPSPAYYRRRDSPGGMDEPPSGWERYDGGHRGQSQKQHRHGG

SEQ ID NO: 1194 - protein, 56 aa, Human herpesvirus 5
PMMSLAHINTVSCPTVMRFDQRLLEEGDEEDEVTVMSPSPEPVQQQPPVEPVQQQP

SEQ ID NO: 1195 - protein, 56 aa, Human herpesvirus 5
KGALNVPRGRPWIGKVPSLKWKLKEQELKIEILKQLQSDIYTKYPQITKNYTQFIT

SEQ ID NO: 1196 - protein, 56 aa, Human herpesvirus 5
VGYYDEEEKRRERQKRVDDEVVQREKQQLKAWEERQQNLQQRQQQPPPPARKPSAS

SEQ ID NO: 1197 - protein, 56 aa, Human herpesvirus 5
KGALNVPRGRPWIGKVPSLKWKLKEQQLKIEILKQLQSDIYTKYPQITKNYTQFIT

SEQ ID NO: 1198 - protein, 56 aa, Human herpesvirus 5; identical to SEQ ID NO: 1151

SEQ ID NO: 1199 - protein, 41 aa, Human herpesvirus 5
GGGGGLDRNSGNYFNDAKEESDSEDSVTFEFVPNTKKQKCG

SEQ ID NO: 1200 - protein, 56 aa, Human herpesvirus 5
VSLRSYDNIPPTSSSDEGEDDDDGEDDDNEERQQKLRLCGSGCGGNDSSSGSHREA

SEQ ID NO: 1201 - protein, 56 aa, Human herpesvirus 5
FGLTVNPRNDTDNHTTPLCPRYVGTQSEEDEDDDYTLSTITNNNMRKTSHRDISHG

SEQ ID NO: 1202 - protein, 56 aa, Human herpesvirus 5
SVSSAPLNKPTPTSVAVTNTPLPGASATPELSPRKKPRKTTRPFKVIIKPPVPPAP

SEQ ID NO: 1203 - protein, 56 aa, Human herpesvirus 5
WKGHKPFRFEAHGSLAPAAEAHAARSAAVGYYDEEEKRRERQKRVDDEVVQREKQQ

SEQ ID NO: 1204 - protein, 56 aa, Human herpesvirus 5
KPSEKKRSSSRRQPQIAAGAPRGSPATPKAGKSPKVSRPPSVPSLPENGAGGGGDD

SEQ ID NO: 1205 - protein, 56 aa, Human herpesvirus 5
PALSSPETGGDSNNDAVAGGGAGGVTSPATRTTSPNALLPEWMDAVHVAVQAAVQA

SEQ ID NO: 1206 - protein, 56 aa, Human herpesvirus 5
LPLIKQEDIKPEPDFTIQYRNKIIDTAGCIVISDSEEEQGEEVETRGATASSPSTG

SEQ ID NO: 1207 - protein, 56 aa, Human herpesvirus 5
CSSSPYQRLETRDWDEEEEASAARERMKHDPENVIYFRKDGNLDTSFVNPNYGRGS

SEQ ID NO: 1208 - protein, 33 aa, Human herpesvirus 5
SEMEEPSNSTSWQIPKLMKVATQPVSLRDPEYD

SEQ ID NO: 1209 - protein, 56 aa, Human herpesvirus 5
INCNVLVNSRGTRRSWPYTVLSYRGKEILKKQKEDILKRLMSTSSDGYRFLMYPSQ

SEQ ID NO: 1210 - protein, 56 aa, Human herpesvirus 5
QQQQRYDELRDAIHELKRDLFAARQSSTLLSAALPSAASSSPTTTTVCTPTGELTS

SEQ ID NO: 1211 - protein, 56 aa, Human herpesvirus 5
INCNVLVNSKGTRRSWPYTVLSYRGKEILKKQKEDILKRLMSTSSDGYRFLMYPSQ

SEQ ID NO: 1212 - protein, 56 aa, Human herpesvirus 5
TVTITSDETSHNVSTNTALISTPWLTNCSATTYTTYNRTNSSNACHTETTIIRFKE

SEQ ID NO: 1213 - protein, 56 aa, Human herpesvirus 5
PPAPTSEPKPKKGRAKDKPKSKPKDKLPCEPTVSSQPPSQPTAMPGGPPDAPPPAM

SEQ ID NO: 1214 - protein, 56 aa, Human herpesvirus 5
GGGETPTALLSGGAKVAERAQAGVVNASCRLATASGSEAATAGPSTAGSSSCPASV

SEQ ID NO: 1215 - protein, 56 aa, Human herpesvirus 5
NLFPYLVSADGTTVTSGNTKDTSLQAPPSYEESVYNSGRKGPGPPSSDASTAAPPY

SEQ ID NO: 1216 - protein, 56 aa, Human herpesvirus 5
HDPENVIYFRKDGNLDTSFVNPNYGRGSPLTIESHLSDNEEDPIRYYVSVYDELTA

SEQ ID NO: 1217 - protein, 56 aa, Human herpesvirus 5
TGSGTPRVTSPTHPLSQMNHPPLPDPLGRPDEDSSSSSSSSCSSASDSESESEEMK

SEQ ID NO: 1218 - protein, 31 aa, Human herpesvirus 5
VSHRANETIYNTTLKSGDVVGVNTTKYPYRV

SEQ ID NO: 1219 - protein, 56 aa, Human herpesvirus 5
REAIVRLEKTPTCQHPKKTPDPMIMFDEDDDDELSLPRNVMTHEEAESRLYDAITE

SEQ ID NO: 1220 - protein, 56 aa, Human herpesvirus 5
SFPQSAHTFLGARSPSLEFDDDANLLSLGGGSAFSSVPKKHVPTQPLDGWSWIASP

SEQ ID NO: 1221 - protein, 56 aa, Human herpesvirus 5
DQFFLKPPQGKTVCLGPEHHLSSWLKGQNSSLWHKVLVTKKGDEPQVQKRGEYPKN

SEQ ID NO: 1222 - protein, 56 aa, Human herpesvirus 5
AEHGRARKRLKSHVNSDGGSGGHAGSNQQQQQRYDELRDAIHELKRDLFAARQSST

SEQ ID NO: 1223 - protein, 56 aa, Human herpesvirus 5
PRNNTDNYTIPVCPRYVETQSQEDEQDDDYTLSTTINNNLMRKTGHYDISHGTHTT

SEQ ID NO: 1224 - protein, 56 aa, Human herpesvirus 5
NQRATAETNLAAGNNSQSVATSLDTNSKNYNQHAKRSVSFNFPSGTWKGGQKTASN

SEQ ID NO: 1225 - protein, 34 aa, Human herpesvirus 5
NSSLWHKVLVTKKGDEPQVQKRGEYPKNRARIIV

SEQ ID NO: 1226 - protein, 31 aa, Human herpesvirus 5
RIPYRPSRQKDNSPLIEPTGTDDEEDEDDNV

SEQ ID NO: 1227 - protein, 56 aa, Human herpesvirus 5
SSASSARQPSASASVLSPTEDDVVSPATSPLSMLSSASPSPAKSAPPSPVKGRGSR

SEQ ID NO: 1228 - protein, 56 aa, Human herpesvirus 5
GLSPYSVSSDAPSSFELVRETGGTGAAKKPSEKKRSSSRRQPQIAAGAPRGSPATP

SEQ ID NO: 1229 - protein, 56 aa, Human herpesvirus 5
ELAEESLKTFEQVTEDCNENPEKDVLAELGDILAQAVNHAGIDSSSTGPTLTTHSC

SEQ ID NO: 1230 - protein, 56 aa, Human herpesvirus 5
HHIYPNTHYKTLIHRRKILTSHPICYSDRSSPTAYHDLCRSCNKTELRLYDLNTTN

SEQ ID NO: 1231 - protein, 56 aa, Human herpesvirus 5
QGRGSHRRRYKESAPQETLPTNHEREILDLMRHSPDVPREAVMSPTMVTIPPPQIP

SEQ ID NO: 1232 - protein, 56 aa, Human herpesvirus 5
EEEEDDEDDLSSTPTPTPLSEAMFAGFEEASGDEDSDTQAGLSPALILTGQRRRSG

SEQ ID NO: 1233 - protein, 56 aa, Human herpesvirus 5
SPSVDDLRAIAEESDEEEAIVAYTLATAGVSSSDSLVSPPESPVPATIPLSSVIVA

SEQ ID NO: 1234 - protein, 56 aa, Human herpesvirus 5
ATNMTSSTNVPTSTSSRNTVESTTSSEPTTETNMTTARESSVHDARNDEIMKVLAI

SEQ ID NO: 1235 - protein, 56 aa, Human herpesvirus 5
LDTTATASAKVADGATRRKHGPYEKEHAERPADAGAVFVAEEGIVLHDGVDEAAES

SEQ ID NO: 1236 - protein, 56 aa, Human herpesvirus 5
KKTTSSIATTTPSLVTTGKVVSTAASSTIISQTNRSHTSNAITTPKTRFEYNITGY

SEQ ID NO: 1237 - protein, 56 aa, Human herpesvirus 5
YVLQRYSDGKKENYYLTVLSGTATSSPIPDKCKTKEESDQHNSRTWDNVIKTVKNT

SEQ ID NO: 1238 - protein, 52 aa, Human herpesvirus 5
HHRRHRRRRSPPPAPRGPAHTRFQGPDSMPSTSYGSDVEDPRDDLAENLRHL

SEQ ID NO: 1239 - protein, 56 aa, Human herpesvirus 5
LRDQTAESPVEDSEEEDDDSSDTGSVVSLGHTTPSSDYNNDVISPPSQTPEQSTPS

SEQ ID NO: 1240 - protein, 56 aa, Human herpesvirus 5
PGRFRFADEEAVNLLDDTDDSGGSSPFGSGSRRGSQIPAGFCSSSPYQRLETRDWD

SEQ ID NO: 1241 - protein, 56 aa, Human herpesvirus 5
TPSCYHRFSSRREAIVRLEKTPTCQHPKKTPDPMIMFDEDDDDELSLPRNVMTHEE

SEQ ID NO: 1242 - protein, 56 aa, Human herpesvirus 5
NGTHVNPWICEEPKHEWDTSHKPTSHKDDTTTSTNHLYRYNNHSNTSHGRHTTWTL

SEQ ID NO: 1243 - protein, 56 aa, Human herpesvirus 5
HNLSIILYEEESQSSVDIAVDEEEPELEDDDEYDELWFPLYFEAECNRNYTLHVNH

SEQ ID NO: 1244 - protein, 56 aa, Human herpesvirus 5
SGTPRVTSPTHPLSQMNHPPLPDPLGRPDEDSSSSSSSSCSSASDSESESEEMKCS

SEQ ID NO: 1245 - protein, 43 aa, Human herpesvirus 5
VKSEPVSEIEEVAPEEEEDGAEEPTASGGKSTHPMVTRSKADQ

SEQ ID NO: 1246 - protein, 56 aa, Human herpesvirus 5
LLDDTGDSGGSSPFGSGSRRGFQIPAGFCSSSPYQRLETRDWDEEEEASAARERMK

SEQ ID NO: 1247 - protein, 56 aa, Human herpesvirus 5
KIEILKQLQSDIYTKYPQITKNYTQFITTELKKFPLYYILAGPIRNESVTHLWFDF

SEQ ID NO: 1248 - protein, 56 aa, Human herpesvirus 5
ILKHAVENGDSADTLLELLIEDFDIYVDSFPQSAHTFLGARSPSLEFDDDANLLSL

SEQ ID NO: 1249 - protein, 56 aa, Human herpesvirus 5
LKKQKEDILKRLMSTSSDGYRFLMYPSQQKFHAIVISMDKFPQDYILAGPIRNDSI

SEQ ID NO: 1250 - protein, 56 aa, Human herpesvirus 5
YVSGLYNCTNCTECNDTEVTIRNCTSTNNTVCASKNYTSFSVPGVQHHKQRQNHTA

SEQ ID NO: 1251 - protein, 56 aa, Human herpesvirus 5
GMDEPPSGWERYDGGHRGQSQKQHRHGGSGGHNKRRKETAAASSSSSDEDLSFPGE

SEQ ID NO: 1252 - protein, 56 aa, Human herpesvirus 5
MLPLIKQEDIKPEPDFTIQYRNKIIDTAGCIVISDSEEEQGEEVETRGATASSPST

SEQ ID NO: 1253 - protein, 56 aa, Human herpesvirus 5
PISTSPRRKPPHPATSTASHHPHASPRSDHTLFPVPSTPSATVHNPRNYAVQLHAE

SEQ ID NO: 1254 - protein, 56 aa, Human herpesvirus 5
EDEDDDYTLSTITNNNMRKTSHRDISHGTRTTWALTLICIACILLFFVRRALNKRY

SEQ ID NO: 1255 - protein, 56 aa, Human herpesvirus 5
NCKVMSKALYNRPWRGLVLSKIGKYKLDQLKLEILRQLETTISTKYNVSKQPVKNL

SEQ ID NO: 1256 - protein, 56 aa, Human herpesvirus 5
CIVISDSEEEQGEEVETRGATASSPSTGSGTPRVTSPTHPLSQMNHPPLPDPLGRP

SEQ ID NO: 1257 - protein, 56 aa, Human herpesvirus 5
RQTSNNTVVAFSHHPADNTLLIEVGNNTRRHVDGISCQDHFRAQHQDCPAQTVHVR

SEQ ID NO: 1258 - protein, 56 aa, Human herpesvirus 5
SSTIATEKKIPFVENAVLKERAFIETIKQHQEPQRRIPRPVDSYVMLHSNARITTS

SEQ ID NO: 1259 - protein, 56 aa, Human herpesvirus 5
SGGGASVTSSHHGRGGFGGAASSSLLSCGHQSSGGASTGPRKKKSKRISELDNEKV

SEQ ID NO: 1260 - protein, 55 aa, Human herpesvirus 5
QHAALRPTSYLRSDMDGDVRTAADISSTLRSVPAPRPSPISTASTSSTPRSRPRI

SEQ ID NO: 1261 - protein, 56 aa, Human herpesvirus 5
QHGVIDGENSETERSVDLVAALLAEAGEESVTEDTEREDTEEEREDEEEENEARTP

SEQ ID NO: 1262 - protein, 56 aa, Human herpesvirus 5
MAQRNGMSPRPPPLGRGRGAGGPSGVGSSPSSSCVPMGATSTAGTAASTAGTATPG

SEQ ID NO: 1263 - protein, 56 aa, Human herpesvirus 5
YNLGADPLRVCSPSVDDLRAIPEESDEEEAIVAYTLATAGVSSSDSLVSPPESPVP

SEQ ID NO: 1264 - protein, 56 aa, Human herpesvirus 5
FRLSDARTLGLDLTTVMTERQSQLPEKYIGFYQIRKPPWLMELPPPPSRQTKPDAA

SEQ ID NO: 1265 - protein, 56 aa, Human herpesvirus 5
MEPEENNVVPNVERRGGEDAVAARMAAGHESDDDEWEDLGFDLEEDTVFDLKDVDE

SEQ ID NO: 1266 - protein, 56 aa, Human herpesvirus 5
HESDDDEWEDLGFDLEEDTVFDLKDVDEWFEQRRLAEKERWHLGQRIVNAYRTEAE

SEQ ID NO: 1267 - protein, 48 aa, Human herpesvirus 5
NYNQHAKRSVSFNFPSGTWKGGQKTASNDTSTKIPHRLSQSHHNLSGV

SEQ ID NO: 1268 - protein, 56 aa, Human herpesvirus 5
EEEEASAARERMKHDPENVIYFRKDGNLDTSFVNPNYGRGSPLTIESHLSDNEEDP

SEQ ID NO: 1269 - protein, 56 aa, Human herpesvirus 5
NHGESSSGGGGCGAASTASAVCVSSLGGSGGTRDGPSAEEQQRRRQEQRHEERRKK

SEQ ID NO: 1270 - protein, 56 aa, Human herpesvirus 5
DLATVVMEAGGQMIHKKTKKPKGKEDESLMKGKHSRYTRPTEPPLTPQASLGRALR

SEQ ID NO: 1271 - protein, 56 aa, Human herpesvirus 5
GGGSAFSSVPKKHVPTQPLDGWSWIASPWKGHKPFRFEAHGSLAPAAEAHAARSAA

SEQ ID NO: 1272 - protein, 56 aa, Human herpesvirus 5
PRSNVMRGAVSEFLPQSPGLPPTEEEEEEEEEDDEDDLSSTPTPTPLSEAMFAGFE

SEQ ID NO: 1273 - protein, 56 aa, Human herpesvirus 5; identical to SEQ ID NO: 1259

SEQ ID NO: 1274 - protein, 56 aa, Human herpesvirus 5
STLTANQNPSPPWSKLTYSKPHDAATFYCPFLYPSPPRSPLQFSGFQQVSTGPECR

SEQ ID NO: 1275 - protein, 56 aa, Human herpesvirus 5
QQLKAQDSLGQQPTTVPPPIDLSIPHVWMPPQTTPHDWKGSHTTSGLHRPHFNQTC

SEQ ID NO: 1276 - protein, 34 aa, Human herpesvirus 5
NTWHKVLLRTKGGDGPHVEEKTASNGRPPWKLKF

SEQ ID NO: 1277 - protein, 56 aa, Human herpesvirus 5
WKQELLKQIGASQDYYKFFTIPTKQGLNAVVTMERFPDNYILAGPIQNDSITYMWF

SEQ ID NO: 1278 - protein, 56 aa, Human herpesvirus 5
MIEGASRQTGLTPKRFMELLDRAPLGQESEPEITEHRDLFADVFRRPVTDAASSSS

SEQ ID NO: 1279 - protein, 56 aa, Human herpesvirus 5
EKQWQQDLQYRREFVKRQLAPKPKSNIVVSHTVSCVIDGGNMTSVWRFEGQFNPHI

SEQ ID NO: 1280 - protein, 56 aa, Human herpesvirus 5
SGSRRGSQIPAGFCSSSPYQRLETRDWDEEEEASAARERMKHDPENVIYFRKDGNL

SEQ ID NO: 1281 - protein, 56 aa, Human herpesvirus 5; identical to SEQ ID NO: 1255

SEQ ID NO: 1282 - protein, 56 aa, Human herpesvirus 5
AASEHHLAEDTVGAASHHHRPCVPARRPRYSKDDDTEGDPDHYPPPLPPSSRHALG

SEQ ID NO: 1283 - protein, 56 aa, Human herpesvirus 5
QAPVKSISKKSRVSTTTPYSSYTSTIFNVSTNVTYSPIVPTRIPTSTIGYRPDENF

SEQ ID NO: 1284 - protein, 56 aa, Human herpesvirus 5; identical to SEQ ID NO: 1262

SEQ ID NO: 1285 - protein, 43 aa, Human herpesvirus 5
SGNVDDALDSLTELKDTVDDVRATLVDSVSATCDLDLEVDDAV

SEQ ID NO: 1286 - protein, 56 aa, Human herpesvirus 5
MSNTAPGPTVANKRDEKHRHVVNVVLELPTEISEATHPVLATMLSKYTRMSSLFND

SEQ ID NO: 1287 - protein, 56 aa, Human herpesvirus 5; identical to SEQ ID NO: 1234

SEQ ID NO: 1288 - protein, 56 aa, Human herpesvirus 5
GSGTPRVTSPTHPLSQMNHPPLPDPLGRPDEDSSSSSSSCSSASDSESESEEMKCS

SEQ ID NO: 1289 - protein, 56 aa, Human herpesvirus 5
MSGNFTEKHFVNVGIVSQSYMDRLQVSGEQYHHDERGAYFEWNIGGHPVTHTVDMV

SEQ ID NO: 1290 - protein, 56 aa, Human herpesvirus 5
ELRRESHSAPPTSRTLPDTILAVKRRSVAQRSHVRLDAKPGLNERDGFRQRLLLPL

SEQ ID NO: 1291 - protein, 56 aa, Human herpesvirus 5
KSARSQRAPFRPRIWHPTVLKKLKQLKLEILRQLEPIPYIKYPQINTTRVQSLTVN

SEQ ID NO: 1292 - protein, 56 aa, Human herpesvirus 5
EEASAARERMKHDPENVIYFRKDGNLDTSFVNPNYGRGSPLTIESHLSDNEEDPIR

SEQ ID NO: 1293 - protein, 56 aa, Human herpesvirus 5
KKEEEDEDDRNDDRERGILCVVSNEDSDVRPAFSLFPARPGCHILRSVIDQQLTRM

SEQ ID NO: 1294 - protein, 56 aa, Human herpesvirus 5
GKKHDRGGGGGSGTRKMSSGGGGGDHDHGLSSKEKYEQHKITSYLTSKGGSGGGGG

SEQ ID NO: 1295 - protein, 56 aa, Human herpesvirus 5
SCGHQSSGGASTGPRKKKSKRISELDNEKVRNIMKDKNTPFCTPNVQTRRGRVKID

SEQ ID NO: 1296 - protein, 55 aa, Human herpesvirus 5
VRKICSCCGNSSESESETTHAYTNAAFTSSDATLPMGTTGSYTPPQDGSFPPPPR

SEQ ID NO: 1297 - protein, 56 aa, Human herpesvirus 5
AGCIVISDSEEEQGEEVETRGATASSPSTGSGTPRVTSPTHPLSQMNHPPLPDPLG

SEQ ID NO: 1298 - protein, 56 aa, Human herpesvirus 5
TASYNVSTNSTVFTMSMPLVTNCSIATNAYNLTNSSNACHTKTEIIRFKETNATGI

SEQ ID NO: 1299 - protein, 56 aa, Human herpesvirus 5
RLEDPLPPWLRKKKACALTRRSRHRLRRQHGVIDGENSETERSVDLVAALLAEAGE

SEQ ID NO: 1300 - protein, 56 aa, Human herpesvirus 5
PVVGYDQLAARHFADYVDPHYPGWGRRYEPAPSLHPSYPVPPPPSPAYYRRRDSPG

SEQ ID NO: 1301 - protein, 56 aa, Human herpesvirus 5; identical to SEQ ID NO: 1299

SEQ ID NO: 1302 - protein, 56 aa, Human herpesvirus 5
HTDSVSAALELSHGAAAGPPEADENNDEGEEDDDELRHSDPAPLHESKKPRNARRP

SEQ ID NO: 1303 - protein, 56 aa, Human herpesvirus 5
VMFTCVMGKKGHRNHRFSGRREAIVRLEKTPTCQHPKKTPDPMIMFDEDDDDELSL

SEQ ID NO: 1304 - protein, 56 aa, Human herpesvirus 5
VCVNSTTVNISTNETTSKAITPTATTNTAKTTSSLVITTPSSVTISKAVSTAASST

SEQ ID NO: 1305 - protein, 56 aa, Human herpesvirus 5
DYTPTFDDLENITTTRAPTRPPAQDLCSHNLSIILYEEESQSSVDIAVDEEEPELE

SEQ ID NO: 1306 - protein, 56 aa, Human herpesvirus 5
NYVGNSGKSRGGGGGGGSLSSLANAGGLHDDGPGLDNDLMNEPMGLGGLGGGGGGG

SEQ ID NO: 1307 - protein, 56 aa, Human herpesvirus 5
HPSEQNQNFNLQIHPRNNTNGTHVDPWVCEEPKHEWDTSPHKPTNYEDNTATSSID

SEQ ID NO: 1308 - protein, 56 aa, Human herpesvirus 5
KRKQAPVKEQFEKKIKKSQSSTTPYFSYTTSTAPNVTTNVTYGVTTTARRVPTSTI

SEQ ID NO: 1309 - protein, 56 aa, Human herpesvirus 5
MYPGAVAAPPSASPAPLPLPSYPASYGAPVVGYDQLAARHFADYVDPHYPGWGRRY

SEQ ID NO: 1310 - protein, 32 aa, Human herpesvirus 5
YGNHKSGSETWLQIKMEGPRNATVVQRSNTRP

SEQ ID NO: 1311 - protein, 56 aa, Human herpesvirus 5
MCPRFLKRTVKLTRNKTKHNVTVTGNNMTTLPVWTPECKGWTYWTTLSVMWRNRRS

SEQ ID NO: 1312 - protein, 44 aa, Human herpesvirus 5
TTEKEAWLQRGRRAKAMHARGHTLKQVPIPEPDQMGDDGPDPGP

SEQ ID NO: 1313 - protein, 56 aa, Human herpesvirus 5
AKTTSSLVITTPSSVTISKAVSTAASSTILSQTNRSHTSNVITTPKTRFEYNITGY

SEQ ID NO: 1314 - protein, 38 aa, Human herpesvirus 5
GHQSSGGASTGPRKKKSKRISELDNEKVRNIMKDKNTP

SEQ ID NO: 1315 - protein, 56 aa, Human herpesvirus 5; identical to SEQ ID NO: 1299

SEQ ID NO: 1316 - protein, 56 aa, Human herpesvirus 5
PKQRHGSTDGKVSAPRQSEHHKRQTRPPRPPPPKFGDRTAAHLSQNMRDMYLDMCT

SEQ ID NO: 1317 - protein, 56 aa, Human herpesvirus 5
SRRGFQIPAGFCSSSPYQRLETRDWDEEEEASAARERMKHDPENVIYFRKDGNLDT

SEQ ID NO: 1318 - protein, 56 aa, Human herpesvirus 5
GETVAAVSAFACPSVSDSLIPEETGVTRPMMSLAHINTVSCPTVMRFDQRLLEEGD

SEQ ID NO: 1319 - protein, 56 aa, Human herpesvirus 5
TNTLAASSITTLNTSTNTTSYTASTLTALSSTHTNSPILSNNATLYTTSLDNTTTD

SEQ ID NO: 1320 - protein, 56 aa, Human herpesvirus 5
VESPPVSAPTVFVPPPSEESHQPVIPPQPPAPTSEPKPKKGRAKDKPKSKPKDKLP

SEQ ID NO: 1321 - protein, 56 aa, Human herpesvirus 5
CKSAARVFRLPFPYGRVLSKNGRLAEIKWKQELLKQIGASQDYYKFFTIPTKQGLN

SEQ ID NO: 1322 - protein, 56 aa, Human herpesvirus 5
PRNNTNETHVNPWICEEPKHEWDTLAATSDKPTSHKDDTTTSSTDHLYRYNNHSNT

SEQ ID NO: 1323 - protein, 30 aa, Human herpesvirus 5
WHKVFIKKNSDNGPHIEDKSDTNRHPPWRL

SEQ ID NO: 1324 - protein, 56 aa, Human herpesvirus 5; identical to SEQ ID NO: 1261

SEQ ID NO: 1325 - protein, 56 aa, Human herpesvirus 5
KGKEDESLMKGKHSRYTRPTEPPLTPQASLGRALRRDDEDWKPSRLPGEDSWYDLD

SEQ ID NO: 1326 - protein, 56 aa, Human herpesvirus 5; identical to SEQ ID NO: 1299

SEQ ID NO: 1327 - protein, 56 aa, Human herpesvirus 5
SKEPETLLEAAQGDNITITHNLTITSCYKTAWLRHFNISTHGKYTHPNIRNGKYYN

SEQ ID NO: 1328 - protein, 31 aa, Human herpesvirus 5
VNAGEDEAGGVGGSSGGGGGSGLLPAKRSRL

SEQ ID NO: 1329 - protein, 56 aa, Human herpesvirus 5
SPSSLLSLPRPSSAHSAGETVQESEAAATAAAAGLMMMRRMRRAPAEAAEAPPQSE

SEQ ID NO: 1330 - protein, 56 aa, Human herpesvirus 5
TLCPNGTYLTGLYNCTNCTQCNDTQITVRNCTSTNNTICASKNHTSFSSPGVQHHK

SEQ ID NO: 1331 - protein, 56 aa, Human herpesvirus 5
VNNITYYNTVRVESLGNETRCMLLPRQYTLNATVEWYNKSEGDVPEEFMDYVILTP

SEQ ID NO: 1332 - protein, 56 aa, Human herpesvirus 5
KYTHPNIKSGKFSNHSLKILHSRVLCEWQTHYLKHHYDLCFTCDQNLSLSLYGLNF

SEQ ID NO: 1333 - protein, 56 aa, Human herpesvirus 5; identical to SEQ ID NO: 1277

SEQ ID NO: 1334 - protein, 56 aa, Human herpesvirus 5
FKLEILKQLEKDIYTKYFNMTRQHIKNLTMNMTEFPRYYILAGPIQNNSVTYLWFD

SEQ ID NO: 1335 - protein, 34 aa, Human herpesvirus 5
KKDNSWHRVLVKIKDSNGPHVEENAVTNKRPRWK

SEQ ID NO: 1336 - protein, 56 aa, Human herpesvirus 5
DEEEEEGAQEEREDTVSVKSEPVSEIEEVAPEEEEDGAEEPTASGGKSTHPMVTRS

SEQ ID NO: 1337 - protein, 56 aa, Human herpesvirus 5
IMLPLIKQEDIKPEPDFTIQYRNKIIDTAGCIVISDSEEEQGEEVETRGATASSPS

SEQ ID NO: 1338 - protein, 32 aa, Human herpesvirus 5
SNSWYKVIIKNGDDNKPKVEKRTEIRKRFKWN

SEQ ID NO: 1339 - protein, 56 aa, Human herpesvirus 5
RNCTSTNNTICASKNHTSFSSPGVQHHKQRQQNHTAHVTVKQRKSGRHTLAWLSLF

SEQ ID NO: 1340 - protein, 14 aa, Human herpesvirus 5
KTTRPFKFGFGLGE

SEQ ID NO: 1341 - protein, 56 aa, Human herpesvirus 5; identical to SEQ ID NO: 1261

SEQ ID NO: 1342 - protein, 56 aa, Human herpesvirus 5
SSAAVSVAPTAAEKVPAECPELTRRCLLGEVFQGDKYESWLRPLVNVTGRDGPLSQ

SEQ ID NO: 1343 - protein, 56 aa, Human herpesvirus 5
PSRPPQKHKPPDKPPRLCKTGPGPPPLPPKQRHGSTDGKVSAPRQSEHHKRQTRPP

SEQ ID NO: 1344 - protein, 56 aa, Human herpesvirus 5
SSAAVSVAPTAAEKVPAECPELTRRCLLGEVFEGDKYESWLRPLVNVTGRDGPLSQ

SEQ ID NO: 1345 - protein, 56 aa, Human herpesvirus 5
NATSSENTTTVMSTLTKYAESDYIFLQDMCPRFLKRTVKLTRNKTKHNVTVTGNNM

SEQ ID NO: 1346 - protein, 56 aa, Human herpesvirus 5
YVCEEHLHSFTEKGDATACPCYRLHKPTFISLNSQVRKTANMFMPGAFMDEIIGGT

SEQ ID NO: 1347 - protein, 56 aa, Human herpesvirus 5
SPSSSTRASTTVKATAVATSSTTTATSTSSTTSAKPGSTTHDPNVMRPHAHNDFYN

SEQ ID NO: 1348 - protein, 56 aa, Human herpesvirus 5
LTLYQDGMLRFNVTCDRTEAPADPVAFRLRLRRETVRRPFFSDAPLPYFVPPRSGA

SEQ ID NO: 1349 - protein, 56 aa, Human herpesvirus 5
KPQHYLLPPRGKPACLAPDHHLSKWLDGKKDNSWHRVLVKIKDSNGPHVEENAVTN

SEQ ID NO: 1350 - protein, 44 aa, Human herpesvirus 5
VEIVRKLDQSDWVRGAWIVSETFPTSDPKGVWSDDDSSMGGSDD

SEQ ID NO: 1351 - protein, 34 aa, Human herpesvirus 5
NTWHKVLLKTKGGDGPHVEERAASNGRPPWKLKF

SEQ ID NO: 1352 - protein, 48 aa, Human herpesvirus 5
PRTPTEPTTLPIVSVSELAPPPRWSDIEELLEKAVQSVMKDAESMQMT

SEQ ID NO: 1353 - protein, 56 aa, Human herpesvirus 5
SRQLKAQDSLGEQPTTVPPPIDLSIPHVWMPPQTTPHGWTESHTTSGLHRPHFNQT

SEQ ID NO: 1354 - protein, 56 aa, Human herpesvirus 5
PKGQQIWAQTAGQAAPHGDEPHSDGELRRESHSAPPTSHTLPETILAVKRRSVAQR

SEQ ID NO: 1355 - protein, 56 aa, Human herpesvirus 5
PFYSEYAGYSENKSCHPRFTCLHDTKGLKLHNVTTNDSGIYTRNVYYCDIPCNISD

SEQ ID NO: 1356 - protein, 56 aa, Human herpesvirus 5
VILHEQKKAFYWRLFLQSQQSQHIDAPITVIQGDTVYLNASNNPCNYSSFWYHGNC

SEQ ID NO: 1357 - protein, 56 aa, Human herpesvirus 5
PAKQYTLNATVEWYNKSEGDIPKEFMNYAILNSVAVLTCGLQEAYILDMTRRITYL

SEQ ID NO: 1358 - protein, 56 aa, Human herpesvirus 5
MAQRNGMSPRPPPLGRGRGAGGPSGVGSSPPSSCVPMGAPSTAGTGASAAATTTPG

SEQ ID NO: 1359 - protein, 56 aa, Human herpesvirus 5
QNKRSTGITSPKDYNVTGLPKGFADSFTGNAEAQRAKDAAHSAWILIVIIIIIVVI

SEQ ID NO: 1360 - protein, 56 aa, Human herpesvirus 5
YLQSSARHPSAGGTASQETLLKAIQFTNGLSAACEDVYNDARKVLKFQGAPLKDER

SEQ ID NO: 1361 - protein, 56 aa, Human herpesvirus 5
LRCAWIQRCCDRFDAWQDEVIYRRPSRRSQSDDQSRTNSVSSYVLLSPASDGGFDN

SEQ ID NO: 1362 - protein, 56 aa, Human herpesvirus 5
ATNCLVKSENTHLTCKCSPNNTSSNTGNGSKCHAMCKCRITEPITMLGAYSAWGAG

SEQ ID NO: 1363 - protein, 56 aa, Human herpesvirus 5
TAAAAGLMMMRRMRRAPAEAAEAPPQSEEENDSTTPVSNCRVPPNSQESAAPQPPR

SEQ ID NO: 1364 - protein, 48 aa, Human herpesvirus 5
TKSGGDLRTSSGTAAKRAAAPLSSVSSNRLTASSSAKRKRPGCLQHEE

SEQ ID NO: 1365 - protein, 56 aa, Human herpesvirus 5
TRSSILSNNASYTTSLDNTTTDITSSESSINVSTVYNTTYIPVTSLAINCTATING

SEQ ID NO: 1366 - protein, 56 aa, Human herpesvirus 5
GCIVISDSEEEQGEEVETRGATASSPSTGSGTPRVTSPTHPLSQMNHPPLPDPLGR

SEQ ID NO: 1367 - protein, 56 aa, Human herpesvirus 5
KDKGTKCLNPNAQAVRRHINRLFFRLILDEEQRIYDVVSTNIEFGAWPVPTAYKAF

SEQ ID NO: 1368 - protein, 29 aa, Human herpesvirus 5
PAAQPKRRRHRQDALPGPCIASTPKKHRG

SEQ ID NO: 1369 - protein, 56 aa, Human herpesvirus 5
CEPTVSSQPPSQPTAMPGGPPDAPPPAMPQMPPGVAEAVQAAVQTAVAAALQQQQQ

SEQ ID NO: 1370 - protein, 41 aa, Human herpesvirus 5
STQLRKPAKYVYSQYNHTAKTITFRPPSCGTVPSMTCLSEM

SEQ ID NO: 1371 - protein, 56 aa, Human herpesvirus 5
ELERLANSSGVNSTRRTKRSTSGNTTTLSLESESVRNVLYAQLQFTYDTLRSYINR

SEQ ID NO: 1372 - protein, 56 aa, Human herpesvirus 5
FRMPKFFPPPMCRVPYNECGVELPGGDSSDEDESGRPRRIANRIGDTPETPCNSEN

SEQ ID NO: 1373 - protein, 56 aa, Human herpesvirus 5
PCAQYFNTEEIIAANKTLFKTIDEYLLRAKDCIRGDTDTQYVCVEGTEQLIENPCR

SEQ ID NO: 1374 - protein, 56 aa, Human herpesvirus 5
EGLRDILGQRHAAEASRAEIAEALERVAERCDDRHGGSDDYVWLSRLLDLAPNYRQ

SEQ ID NO: 1375 - protein, 53 aa, Human herpesvirus 5
QDEAHSFSLKLTERKTVDGWPVGLGLLDVLNANYPNLPSPPKLPPRWERGEEE

SEQ ID NO: 1376 - protein, 56 aa, Human herpesvirus 5
YRPAFLLMPAATAVSTSGTTSKESTSGVTPEDSIAAQRQAVGEMLTELVEDVATDA

SEQ ID NO: 1377 - protein, 56 aa, Human herpesvirus 5
RCFEKQVGDAVDNENVTLNHLAVVRAMVMGEDTVPYNKPRRHPQQKQKNNPYHVEV

SEQ ID NO: 1378 - protein, 56 aa, Human herpesvirus 5
CTHNVLTRPIGGVFWIGRDPPKPPECDKPQHFLLTSQGKTVCLGPDHHITKWLDGQ

SEQ ID NO: 1379 - protein, 53 aa, Human herpesvirus 5
RQSQRVMHPHAFGMRAVSQFLVTHPLGEPEAHGAFAPETPVGTRSPLRSYAIL

SEQ ID NO: 1380 - protein, 56 aa, Human herpesvirus 5
KPPRNPRLPRTVGLENLSKVGLSCPCPRPRTPTEPTTLPIVSVSELAPPPRWSDIE

SEQ ID NO: 1381 - protein, 39 aa, Human herpesvirus 5
KFMSKCDKHEWFEVTFNSTRKYPMITRKGSTKPTFSSGK

SEQ ID NO: 1382 - protein, 56 aa, Human herpesvirus 5
PCSTTVNYSTSTETATSTYSTTVISNKSTSESINCSTATAPATTVSTKPSKTTTQI

SEQ ID NO: 1383 - protein, 56 aa, Human herpesvirus 5
PCTHKALHHPIGGLFWVGRDPPNPPECDKPQHYLLPPRGKPACLAPDHHLSKWLDG

SEQ ID NO: 1384 - protein, 56 aa, Human herpesvirus 5
ILKDKGTKCLNPNAQAVRRHINRLFFRLILDEEQRIYDVVSTNIEFGAWPVPTAYK

SEQ ID NO: 1385 - protein, 51 aa, Human herpesvirus 5
TNIPLGIHAVWAGVVVSVALVALYMGSRRASRKPRYKKLPKYDPDEFWTKT

SEQ ID NO: 1386 - protein, 56 aa, Human herpesvirus 5
FETTGGLVVFWQGIKQKSLVELERLANRSSLNLTHNRTKRSTDGNNATHLSNMESV

SEQ ID NO: 1387 - protein, 56 aa, Human herpesvirus 5
TMIYDMVQYGHRRRPGHGDDPDRVICEIVESPPVSAPTVFVPPPSEESHQPVIPPQ

SEQ ID NO: 1388 - protein, 56 aa, Human herpesvirus 5
QRRRARRLHAVSEGKLQEEKKRQSALVWNVEARPFPSTHQLIVLPPPVASAPPAVP

SEQ ID NO: 1389 - protein, 56 aa, Human herpesvirus 5
SEPEITEHRDLFADVFRRPVTDAASSSSASSSSSSASPNSVSLPSARSSSTRTTTP

SEQ ID NO: 1390 - protein, 56 aa, Human herpesvirus 5
IPDKCKTKEESDQHRRGAWDDVITTVKNTNIPLGIHAVWAGVVVSVALVALYMGSR

SEQ ID NO: 1391 - protein, 56 aa, Human herpesvirus 5
YRDVIHTTLRRMTVPVPRRYPKGARTMHVLFLNDTTPEGSYATAERILGCDVKLHT

SEQ ID NO: 1392 - protein, 32 aa, Human herpesvirus 5
VAPEEEEDGAEEPTASGGKSTHPMVTRSKADQ

SEQ ID NO: 1393 - protein, 33 aa, Human herpesvirus 5
ACVIKVSRKKREDALLKQMRSEYGNAPVFGSGV

SEQ ID NO: 1394 - protein, 56 aa, Human herpesvirus 5
EDEDSDDASSQDLVRATDRHGDTVVYKTTAVPPSPPAPLAGVRSHRGELNLMTPSP

SEQ ID NO: 1395 - protein, 56 aa, Human herpesvirus 5
LLNTLPVGTELLKPIAASESCNRQEVLAILKDKGTKCLNPNAQAVRRHINRLFFRL

SEQ ID NO: 1396 - protein, 56 aa, Human herpesvirus 5
VFWQGIKQKSLLELERLANSSGVNSTRRTKRSTGNTTTLSLESESVRNVLYAQLQF

SEQ ID NO: 1397 - protein, 56 aa, Human herpesvirus 5
SATTSKSSASVSTTKLTKLSSTTHDPNVMRRHANDDFYKAHCTSHMYELSLSSFAA

SEQ ID NO: 1398 - protein, 56 aa, Human herpesvirus 5
MGAELCKRICCEFGTTPGEPLKDALGRQVSLRSYDNIPPTSSSDEGEDDDDGEDDD

SEQ ID NO: 1399 - protein, 56 aa, Human herpesvirus 5
MMEAAAAAAAAFRPEERPTPGWHDAALLMDDGTVREHAFRNGPLSQLIRRVLPPPP

SEQ ID NO: 1400 - protein, 56 aa, Human herpesvirus 5
SVMKRRIEEICMKVFAQYILGADPLRVCSPSVDDLRAIAEESDEEEAIVAYTLATA

SEQ ID NO: 1401 - protein, 56 aa, Human herpesvirus 5
VYRLAEDVVMFTCVMGKKGHRNHRFSGRREAIVRLEKTPTCQHPKKTPDPMIMFDE

SEQ ID NO: 1402 - protein, 56 aa, Human herpesvirus 5
ALGTITRSQLESALDWFLRPTRGTDKVPNNSSAWGRTDLLPTGALQDNQNWAFPSH

SEQ ID NO: 1403 - protein, 42 aa, Human herpesvirus 5
SLNLTHNRTKRSTDGNNATHLSNMESVHNLVYAQLQFTYDTL

SEQ ID NO: 1404 - protein, 56 aa, Human herpesvirus 5
SSVAVSVAPTAAEKVPAECPELTRRCLLGEVFQGDKYESWLRPLVNVTGRNGPLSQ

SEQ ID NO: 1405 - protein, 56 aa, Human herpesvirus 5; identical to SEQ ID NO: 1321

SEQ ID NO: 1406 - protein, 56 aa, Human herpesvirus 5
SSAAVSVAPTATEKVPAECPELTRRCLLGEVFQGDKYESWLRPLVNVTGRDGPLSQ

SEQ ID NO: 1407 - protein, 56 aa, Human herpesvirus 5
DYYRVPHYWDACSRALPDQTRYKYVEQLVDLTLNYHYDASHGLDNFDVLKRINVTE

SEQ ID NO: 1408 - protein, 40 aa, Human herpesvirus 5
DHESLEAWEQGSDVEAPPLPEKSPCPEHVPEIRVEIPRYV

SEQ ID NO: 1409 - protein, 56 aa, Human herpesvirus 5
EECYDQRFTTEGHQVIPLCASEPEDDDEDPTYDELPSRPPQKHKPPDKPPRLCKTG

SEQ ID NO: 1410 - protein, 56 aa, Human herpesvirus 5
EQYHHDERGAYFEWNIGGHPVTHTVDMVDITLSTRWGDPKKYAACVPQVRMDYSSQ

SEQ ID NO: 1411 - protein, 56 aa, Human herpesvirus 5
RLTTQNHAQFPHVLGASPRFSSPAEFALHVKGLKTAGVPAPMAATVARESLVRSVF

SEQ ID NO: 1412 - protein, 56 aa, Human herpesvirus 5; identical to SEQ ID NO: 1291

SEQ ID NO: 1413 - protein, 56 aa, Human herpesvirus 5
KDWVTNASHDTVRIQSLGNEIRCMLLPRQYTLNATVEWYNKSEGDVPEEFMDYVIL

SEQ ID NO: 1414 - protein, 56 aa, Human herpesvirus 5; identical to SEQ ID NO: 1247

SEQ ID NO: 1415 - protein, 40 aa, Human herpesvirus 5
QVAGNGRRRGPSFLEDGLEIIDPSEEAAIAAASIAAFFDD

SEQ ID NO: 1416 - protein, 56 aa, Human herpesvirus 5
SSSSSRRSRRRNNRHEDEEDNDPLLRLSQVAGNGRRRGPSFLEDGLEIIDPSEEAA

SEQ ID NO: 1417 - protein, 56 aa, Human herpesvirus 5
GVMTRGRLKAESTVAPEEDTDEDSDNEIHNPAVFTWPPWQAGILARNLVPMVATVQ

SEQ ID NO: 1418 - protein, 56 aa, Human herpesvirus 5
PDKCKTKEESDQHNSRTWDNVIKTVKNTNIPLGIHAVWAGIVVSVALIALYMGSRR

SEQ ID NO: 1419 - protein, 56 aa, Human herpesvirus 5
PQGQQIWPQTAGQAAPHGDEPHSDGELRRESHSAPPTSRTLPDTILVVKRRSVAQR

SEQ ID NO: 1420 - protein, 56 aa, Human herpesvirus 5
LKRKQAPVKEQFEKKAKKTQSTTTPYFSYTTSAALNVTTNVTYSITTAARRVSTST

SEQ ID NO: 1421 - protein, 56 aa, Human herpesvirus 5
LWESWVANDTSHNTTRIELLKNETRCTLPAKQYTLNATVEWYNKSEGDIPKEFMNY

SEQ ID NO: 1422 - protein, 56 aa, Human herpesvirus 5
RFRFADEEAVNPLDDTDDSGGSSPFGSGSRRGFQIPAGFCSSSPYQRLETRDWDEE

SEQ ID NO: 1423 - protein, 56 aa, Human herpesvirus 5
SSVAVSVAPTAAEKVPAECPELTRRCLLGEVFQGDKYESWLRPLVNVTGRDGPLSQ

SEQ ID NO: 1424 - protein, 56 aa, Human herpesvirus 5
SPPSSCVPMGAPSTAGTGASAAATTTPGHGVHRVEPRGPPGAPPSSGNNSNFWHGP

SEQ ID NO: 1425 - protein, 56 aa, Human herpesvirus 5
SHPLSAAVPAATAPPGATVAGASPAVSSLAWPHDGVYLPKDAFFSLLGASRSAVPV

SEQ ID NO: 1426 - protein, 56 aa, Human herpesvirus 5
ATNMTSSTTVPTSTSSKNNVESATSSGPTIGINMTTTHESSVHNARNDEIMKVLAI

SEQ ID NO: 1427 - protein, 56 aa, Human herpesvirus 5
ILLHEQKKAFYWRLFLQSQHVEAPITVTQGDTVYLDASNNPCNYSSFWYHGNCELC

SEQ ID NO: 1428 - protein, 56 aa, Human herpesvirus 5
GVSSSDSLVSPPESPVPATIPLSSVIVAENSDQEESEQSDEEEEEGAQEEREDTVS

SEQ ID NO: 1429 - protein, 56 aa, Human herpesvirus 5
TKHPAICANVEDYLQDARRRADAQALGLDLATVVMEAGGQMIHKKTKKPKGKEDES

SEQ ID NO: 1430 - protein, 56 aa, Human herpesvirus 5
QDPVRRMLLDKEQMALKVTCNAFYGFTGVVNGMMPCLPIAASITRIGRDMLERTAR

SEQ ID NO: 1431 - protein, 56 aa, Human herpesvirus 5
DENFYLLVTPKNHTEAINATFVCPRYNTDIENEDREKGSQHTNNTHHHKRNLYHSS

SEQ ID NO: 1432 - protein, 56 aa, Human herpesvirus 5
LAWPHDGVYLPKDAFFSLLGASRSAVPVMYPGAVAAPPSASPAPLPLPSYPASYGA

SEQ ID NO: 1433 - protein, 56 aa, Human herpesvirus 5
HRHRALAPMTWPAGTGVAAAAEADRALREFLEAPWESAPQPPRLRMTPDTDHEEST

SEQ ID NO: 1434 - protein, 44 aa, Human herpesvirus 5
ATIPLSSVIVAENSDQEESEQSDEEEEEGAQEEREDTVSVKSEP

SEQ ID NO: 1435 - protein, 56 aa, Human herpesvirus 5
EAIVAYTLATAGVSSSDSLVSPPESPVPATIPLSSVIVAENSDQEESEQSDEEEEE

SEQ ID NO: 1436 - protein, 56 aa, Human herpesvirus 5
SSSVTRVPEKPFKGQELAGRITPPPVDFQRPVFKTLLDQQADAARKALSDEADLLN

SEQ ID NO: 1437 - protein, 56 aa, Human herpesvirus 5
VREEIPASDDVLFFVDGCEALAASLMDKFAALQEQGVEDFSLENLRRVLDADAQRL

SEQ ID NO: 1438 - protein, 56 aa, Human herpesvirus 5
TDAAGGEVHDLSALFAPSGVGAASGVGGGGLLLGESVAGNSICFGVPGETGGGCFL

SEQ ID NO: 1439 - protein, 56 aa, Human herpesvirus 5
FAALQEQGVEDFSLENLRRVLDADAQRLTDAAGGEVHDLSALFAPSGVGAASGVGG

SEQ ID NO: 1440 - protein, 56 aa, Human herpesvirus 5
FTTEGHQVIPLCASEPEDDDEDPTYDELPSRPPQKHKPPDKPPRLCKTGPGPPPLP

SEQ ID NO: 1441 - protein, 56 aa, Human herpesvirus 5
MKRMIRSHGRKTECQMTSAGERRGSAVGAPICGSGTRRGSGANERRDSDVGPIAHS

SEQ ID NO: 1442 - protein, 34 aa, Human herpesvirus 5
NSNSWYKVFITTNGNNGPQIHKRAEHNKRPKWKL

SEQ ID NO: 1443 - protein, 56 aa, Human herpesvirus 5
SVTVEQPSTSADGSNTTPSKNVTLSQGGSTTDGDEDYSGEYDVLITDGDGSEHQQP

SEQ ID NO: 1444 - protein, 56 aa, Human herpesvirus 5
RYSKDDDTEGDPDHYPPPLPPSSRHALGGTGGHIIMGTAGFRGGHRASSSFKRRVA

SEQ ID NO: 1445 - protein, 32 aa, Human herpesvirus 5
HENGIYYGTRSMRKLNKPTCPYGVDHQLFDDA

SEQ ID NO: 1446 - protein, 56 aa, Human herpesvirus 5
SATTSKSSASVSTTKLTTVATTSATTTTTTTLSTTSTKLSSTTHDPNVMRRHANDD

SEQ ID NO: 1447 - protein, 56 aa, Human herpesvirus 5
PTAAFSSQPRRARRLPVPAATRSVARPLSPQTPTPVGLLPAARASLSDLADVPAVA

SEQ ID NO: 1448 - protein, 56 aa, Human herpesvirus 5
SPQTPTPVGLLPAARASLSDLADVPAVAAGLSQRGSSRPGGRSRLPGGLAFGLRSW

SEQ ID NO: 1449 - protein, 56 aa, Human herpesvirus 5
DPTYDELPSRPPQKHKPPDKPPRLCKTGPGPPPLPPKQRHGSTDGKVSAPRQSEHH

SEQ ID NO: 1450 - protein, 56 aa, Human herpesvirus 5
TLNATVEWYNKSEGDVPEEFMDYVILTPLAVLTCGLQEAYILDKGRRYMYLFSVSC

SEQ ID NO: 1451 - protein, 56 aa, Human herpesvirus 5
RCTYHGTDINVTSNATSMNCRLNCTCNHTQIYNGPCAGAESKLPLNVTFRQSRRQW

SEQ ID NO: 1452 - protein, 56 aa, Human herpesvirus 5
MTSPRLSASENYDGNYELTETANTTRTNTSDWITLGTSASLLKSTETAVNLSNATT

SEQ ID NO: 1453 - protein, 56 aa, Human herpesvirus 5
CEEPKHEWDTSPHKPTNYEDNTATSSIDHLYRYNNHSNTSHGRRTTWTLALICVAC

SEQ ID NO: 1454 - protein, 47 aa, Human herpesvirus 5
STTDGDEDYSGEYDVLITDGDGSEHQQPQKTDEHKENQAKENEKKIQ

SEQ ID NO: 1455 - protein, 56 aa, Human herpesvirus 5
RPLNGAMYYGSGCHFDTVEMVDETRPAPPALSSPETGGDSNNDAVAGGGAGGVTSP

SEQ ID NO: 1456 - protein, 56 aa, Human herpesvirus 5
SGRYSRRCYKQYHHQGPHEDENFGLTVNPRNNTDNYTIPVCPRYVETQSQEDEQDD

SEQ ID NO: 1457 - protein, 41 aa, Human herpesvirus 5
WAGIVVSVALIALYMGNRRRPRKPRYTRLPKYDPDESWTKT

SEQ ID NO: 1458 - protein, 48 aa, Human herpesvirus 5
RRGAGSVPAGNRGKKTIITEYRITGTRALARCPTKPVTSMWNSSWTSR

SEQ ID NO: 1459 - protein, 56 aa, Human herpesvirus 5
KWVGNDTSHNTTRIELLKNETRCTLPAKQYTLNVTVEWYNKSEGDIPKEFMSYAIL

SEQ ID NO: 1460 - protein, 56 aa, Human herpesvirus 5
MGEDTVPYNKPRRHPQQKQKNNPYHVEVPQELIDNFLEHSSPSRDRFVQLLFYMWA

SEQ ID NO: 1461 - protein, 56 aa, Human herpesvirus 5
YDTEAATKAIYDHREADAQTFAATHNPWASQAGCLSDVLYNTRHRERLGYNSKFYS

SEQ ID NO: 1462 - protein, 56 aa, Human herpesvirus 5
KTITFRPPSCGTVPSMTCLSEMLNVSKRNDTGEQGCGNFTTFNPMFFNVPRWNTKL

SEQ ID NO: 1463 - protein, 56 aa, Human herpesvirus 5
SDEDESGRPRRIANRIGDTPETPCNSENEDDTTVEGTSGGPEAMDSQAPYPSEDSP

SEQ ID NO: 1464 - protein, 49 aa, Human herpesvirus 5
THMWFDFYSTQLRKPAKYVYSEYNHTAHKITLRPPPCGTVPSMNCLSEM

SEQ ID NO: 1465 - protein, 56 aa, Human herpesvirus 5
DFRCAPPTKRRTSYTPQKPARLRAPNLCVISTSQHDTNRVTWFPEHVRGTDPRHVL

SEQ ID NO: 1466 - protein, 56 aa, Human herpesvirus 5
TLILAARDADEWFRHGAGEVVRLYRCNRLGVGTPRATLLPQPALRQTLLRAEEATA

SEQ ID NO: 1467 - protein, 46 aa, Human herpesvirus 5
IRYYVSVYDELTASEMEEPSNSTSWQIPKLMKVAMQPVSLRDPEYD

SEQ ID NO: 1468 - protein, 55 aa, Human herpesvirus 5
RPPPPKFGDRTAAHLSQNMRDMYLDMCTSSGHRPRPPAPPRPKKCQTHAPHHVHH

SEQ ID NO: 1469 - protein, 56 aa, Human herpesvirus 5
APTVRAQSTVVRSEPAPPSETRRDNNDTSYFSSTSFHSSVSPATSVDRQFRRTTYD

SEQ ID NO: 1470 - protein, 56 aa, Human herpesvirus 5
KTHRTIVVAPRRGFLRIPPDGQDVNHVKIVPTTSSSLAPPRDDERRPTPPLRPPLT

SEQ ID NO: 1471 - protein, 56 aa, Human herpesvirus 5
IGFYQIRKPPWLMELPPPPSRQTKPDAATMPPPLSAQASVSYALRYDDESWRPLST

SEQ ID NO: 1472 - protein, 56 aa, Human herpesvirus 5
YSFRCYINGHPSEQNQNFNLQVHPRNNTNGTHVNPWICEEPKHEWDTSHKPTSHKD

SEQ ID NO: 1473 - protein, 56 aa, Human herpesvirus 5
ESQTAPATSQEEETAASHELEKKKEKEEKKEEEDEDDRNDDRERGILCVVSNEDSD

SEQ ID NO: 1474 - protein, 56 aa, Human herpesvirus 5
VNVTENVSTPLPICSSSNNTLNDTSNNHTCYHENNTISKEPEILLYAVQGDNITIT

SEQ ID NO: 1475 - protein, 47 aa, Human herpesvirus 5
MPVEMLRKLDQSDWVRGAWIVSETFPTSDPKGFWSDDDSSMGGSEDC

SEQ ID NO: 1476 - protein, 56 aa, Human herpesvirus 5
GKCNNTTANTSMSTALTSLIPTTQLSSTLETTGMSTTTFTSSTNASTGFTTNSVKS

SEQ ID NO: 1477 - protein, 56 aa, Human herpesvirus 5
YALYASTPALFDFLRVVRQQDAFICTDYVYCALRLLACPDRPIIGDTGGSSSSQRL

SEQ ID NO: 1478 - protein, 56 aa, Human herpesvirus 5
SSDKASSRANGTISWMANVSAAYPTYLDGERAKGDLIFNQTEQNLLELEIALGYRS

SEQ ID NO: 1479 - protein, 56 aa, Human herpesvirus 5
TLCPNGTYVSGLYNCTNCTECNDTEVTIRNCTSTNNTVCASKNHTSLSVPGVQHHK

SEQ ID NO: 1480 - protein, 56 aa, Human herpesvirus 5
HFHTMRDYQRPMVQYDDYWNAVMLYRGDVESLSAEVTKRGYASYTIDDPFDECPDT

SEQ ID NO: 1481 - protein, 47 aa, Human herpesvirus 5
FLWDIPSCDRCVRRRRFKVCDAGRRHIIPGAANGMPPLTPPHAYMNN

SEQ ID NO: 1482 - protein, 56 aa, Human herpesvirus 5
NVTVLAGQQLITQTMPHTPQAVATFKFFHQDPNRVLDCIRPVVPRSTSYHETGVYQ

SEQ ID NO: 1483 - protein, 56 aa, Human herpesvirus 5
LGDILAQAVNHAGIDSSSTGPTLTTHSCSVSSAPLNKPTPTSVAVTNTPLPGASAT

SEQ ID NO: 1484 - protein, 56 aa, Human herpesvirus 5
KKAASTSLAVRNHVTVSSHSGSGPSLWRARMSAALTRTAGKRSSRTASPPPPPRHP

SEQ ID NO: 1485 - protein, 56 aa, Human herpesvirus 5
DYYYYREDEPRQHGEPNYVAPPARQFRFPPLNNVSSYQASCVVKDGVLDAVWRVQG

SEQ ID NO: 1486 - protein, 56 aa, Human herpesvirus 5
SLSVELSAGHKKKEIPTEGGWGGEEGEDDVLATIRNTLSAPTSPAAATTHRLSFPG

SEQ ID NO: 1487 - protein, 56 aa, Human herpesvirus 5
LEILKQLEREPYTKYFNMTRQHVKNLTMNMTQFPQYYILAGPIRNDSITYLWFDFY

SEQ ID NO: 1488 - protein, 56 aa, Human herpesvirus 5
CKVVRPPGRYWLGTVLSTIGKQKLDKFKLEILKQLEREPYTKYFNMTRQHVKNLTM

SEQ ID NO: 1489 - protein, 56 aa, Human herpesvirus 5
KAGKSPKVSRPPSVPSLPENGAGGGGDDNSSSGGSSSRTTSNSSRSTSPVAPGEPS

SEQ ID NO: 1490 - protein, 56 aa, Human herpesvirus 5
SNTNTSIIHFVQQDELVDNPAYFRRSNHRAFMIVILTQVVFVVFIINASFIWSWTF

SEQ ID NO: 1491 - protein, 36 aa, Human herpesvirus 5
VRRRRFKVCDVGRRHIIPGAANGMPPLTPPHAYMNN

SEQ ID NO: 1492 - protein, 56 aa, Human herpesvirus 5
TNTTGIEGSNVTIKGNSTWDCLSVAWIRHYNRSTHGHHLGHRKNAHTQSWYWLRIL

SEQ ID NO: 1493 - protein, 56 aa, Human herpesvirus 5
GWEGERHRVVHYIPGTSGLLPSCEEDERELCVPFISQSIADNNCSRRHRVDGARRR

SEQ ID NO: 1494 - protein, 56 aa, Human herpesvirus 5
STQLRKPAKYVYSQYNHTAKTITFRPPSCGTVPSMTCLSEMLNVSKRNDTGEQGCG

SEQ ID NO: 1495 - protein, 56 aa, Human herpesvirus 5
TPCPNGTYVSGLYNCTDCTQCNVTQVMIRNCTSTNNTVCAPKNHTYFSTPGVQHHK

SEQ ID NO: 1496 - protein, 56 aa, Human herpesvirus 5
PKGQQIWTQTAGQAAPHGDEPHSDGELRRESHSAPPTSRTLPDTILAVKHRSVAQR

SEQ ID NO: 1497 - protein, 56 aa, Human herpesvirus 5
FNLTVRPQVVQSTTTVVTPAVVTNSTASVSPIALNLTTNFTAFGYASYQRKKRVEN

SEQ ID NO: 1498 - protein, 56 aa, Human herpesvirus 5
NSSSGGSSSRTTSNSSRSTSPVAPGEPSAAEGDEFSFCDSDIEDFERECYRVSVAD

SEQ ID NO: 1499 - protein, 56 aa, Human herpesvirus 5
LRLNNVTSSDSGTYTEYVYECDLPCNTSDYDEYDILNYLDNCTTTINSTNYIITVL

SEQ ID NO: 1500 - protein, 56 aa, Human herpesvirus 5
SSVAVSVAPTAAEKVPAECPELTRRCLLGEVFQGDKYESWLRPLVNVTRRDGPLSQ

SEQ ID NO: 1501 - protein, 56 aa, Human herpesvirus 5
LVNAMSRNLFRVPKYINGTKLKNTMRKLKRKQAPVKEQFEKKIKKSQSSTTPYFSY

SEQ ID NO: 1502 - protein, 56 aa, Human herpesvirus 5
KTLATASSSSPSAIAAASSSSAVPPSYSCGEGALPALGRYQQLVDEVEQELKALTL

SEQ ID NO: 1503 - protein, 56 aa, Human herpesvirus 5
LTTLSSVSTTTVLGHATFSACVRSDVMRDGEKEDAASDKENLRRPVVPSTSSRGSA

SEQ ID NO: 1504 - protein, 56 aa, Human herpesvirus 5
HSDGELRRESHSAPPTSRTLPDTILAVKRRSVAQRSHVRLDAKPGLNERDGFRRRL

SEQ ID NO: 1505 - protein, 36 aa, Human herpesvirus 5
LFTVAVQRVKQERDAHLRRYEERLRKNRARRRQSFP

SEQ ID NO: 1506 - protein, 56 aa, Human herpesvirus 5
VTSPINTTVTSTTSISTSNNVTSAVSTTVQTSISTSGSTFTSAATSVAATTQKEGH

SEQ ID NO: 1507 - protein, 56 aa, Human herpesvirus 5
PAVPSRGGRVSSGLSTFNPAGATRMELDSVEEEDDFGASLCKVSPPIQATRMLMGK

SEQ ID NO: 1508 - protein, 56 aa, Human herpesvirus 5
HYNRSTHGHHLGHRKNAHTQSWYWLRILTSHTVCHSQHERPSLYHDLCRSCNNTEL

SEQ ID NO: 1509 - protein, 56 aa, Human herpesvirus 5
PSRARRRQWMREAAQAAAQAAVQAAQAAAAQVAQAHVDENEVVDLMADEAGGGVTT

SEQ ID NO: 1510 - protein, 56 aa, Human herpesvirus 5
ESVSTDNATTISSFTTVTPNATSYNTTITASYNVSTNSTVFTMSMPLVTNCSIATN

SEQ ID NO: 1511 - protein, 56 aa, Human herpesvirus 5
MTSVNKQLLKDVMRVDLERQQHQFLRRTYGPQHRLTTQQALTVMRVAAREQTRYSQ

SEQ ID NO: 1512 - protein, 36 aa, Human herpesvirus 5
KWLDKRNDNRWYNVNVTRQPERGPGKITVTLVGLKE

SEQ ID NO: 1513 - protein, 56 aa, Human herpesvirus 5
QQRERQRLDKSQAATAPSAAAGPPADRDVVDQRTETYAYETPRYVTRCLTRYTTPV

SEQ ID NO: 1514 - protein, 56 aa, Human herpesvirus 5
YRPHGVGRLRGLRYHLHNLLFTDRSRLFSIRQSAIRLPPGRLLRTLRPHLPHRAVR

SEQ ID NO: 1515 - protein, 56 aa, Human herpesvirus 5
LHLHPRAALWAREPHGQLAFLLRPGRGEAEVLTLATKHPAICANVEDYLQDARRRA

SEQ ID NO: 1516 - protein, 56 aa, Human herpesvirus 5
DAQALGLDLATVVMEAGGQMIHKKTKKPKGKEDESLMKGKHSRYTRPTEPPLTPQA

SEQ ID NO: 1517 - protein, 56 aa, Human herpesvirus 5
TAVTLVTATLAAASATFPTVRRSVSSSPAAKQPAPGTVAQSFPPGELALRDETGGR

SEQ ID NO: 1518 - protein, 56 aa, Human herpesvirus 5
SSAAVNVAPTAAEKVPAECPELTRRCLLGEVFQGDEYESWLRPLVNVTGRDGPLSQ

SEQ ID NO: 1519 - protein, 56 aa, Human herpesvirus 5
ENSDQEESEQSDEEEEEGAQEEREDTVSVKSEPVSEIEEVAPEEEEDGAEEPTASG

SEQ ID NO: 1520 - protein, 56 aa, Human herpesvirus 5
DVVEPLDLELGLMRVATHPPTPQVPRCTSLYIGEDGLPIDKPEFPPARFEIPDVST

SEQ ID NO: 1521 - protein, 56 aa, Human herpesvirus 5
KYTRRDRYNGYEENYYVTVLYEGSTSSTPGTCPVKYRVKSSESTNTEGTVGSNLIE

SEQ ID NO: 1522 - protein, 56 aa, Human herpesvirus 5
FRANELRNQQFMTYGTENSLKNTSLTRPLGAAGGVRETIGEPQDRDVADSATQRVF

SEQ ID NO: 1523 - protein, 56 aa, Human herpesvirus 5
PPSEATAGRWPVDRFLRVPLQRAPDPRLRTIHPVTESALARKSRGLAGVTRQIHRA

SEQ ID NO: 1524 - protein, 56 aa, Human herpesvirus 5
RCYADATSAAVVVTTTTSEKATLVEHAEGMASEMCPGTTIDVSAESSSVLCTDGEN

SEQ ID NO: 1525 - protein, 56 aa, Human herpesvirus 5
NWSTHGHHIYPNRRYQTPTYQHKILTSHPICHPDVSSPAAYHDLCRSCNKTELRIY

SEQ ID NO: 1526 - protein, 56 aa, Human herpesvirus 5
QYTLNATVEWYNKSEGDVPEEFMDYVILTPLAVLTCGLQEAYILDKGRRYMYLFSV

SEQ ID NO: 1527 - protein, 56 aa, Human herpesvirus 5
DQYYLKPPKGKAVCLAPQHHLSIWLNGQNSSLWHRVLVTGKNGNGPHVTKKGDFPR

SEQ ID NO: 1528 - protein, 56 aa, Human herpesvirus 5
TLAVYGRDPEWVTQRFPDLTAADRDGLRAQWQRCGSTAVDASGDPFRSDSYGLLGN

SEQ ID NO: 1529 - protein, 56 aa, Human herpesvirus 5
NTTRTNTSDWITLGSSASLLKSTETAVNLSNATTVIPQPVEYPAGGVQYQRAATHY

SEQ ID NO: 1530 - protein, 56 aa, Human herpesvirus 5
RTIHPVTESALARKSRGLAGVTRQIHRAVPQHIADYNDGGDMGSRFDNLPGVAASV

SEQ ID NO: 1531 - protein, 56 aa, Human herpesvirus 5
MLEAGAAATVAPLTPPAVVQGESGVREDGETVAAVSAFACPSVSDSLIPEETGVTR

SEQ ID NO: 1532 - protein, 44 aa, Human herpesvirus 5
ATRTTSPNALLPEWMDAVHVAVQAAVQATVQVSGPRENAVSPAT

SEQ ID NO: 1533 - protein, 56 aa, Human herpesvirus 5
NTLPVGTELLKPIAASESCNRQEVLAILKDKGTKCLNPNAQAVRRHINRLFFRLIL

SEQ ID NO: 1534 - protein, 56 aa, Human herpesvirus 5
LFVASSPVNLLELEDYDRRCRCNNQILLNTLPVGTELLKPIAASESCNRQEVLAIL

SEQ ID NO: 1535 - protein, 56 aa, Human herpesvirus 5
QILLNTLPIGTELLKPIAASESCNRQEVLAILKDKGTKCLNPNAQAVRRHINRLFF

SEQ ID NO: 1536 - protein, 33 aa, Human herpesvirus 5
YRHHGSDTEIWFQIEFKGPQNTKVVSKSFTPPS

SEQ ID NO: 1537 - protein, 56 aa, Human herpesvirus 5
YVRERPYIGGRSRPTTFHLTRKKKAPLGGDLSPSFARSPVLEPSSPPQALSVPSLS

SEQ ID NO: 1538 - protein, 56 aa, Human herpesvirus 5
LGQGSFGEVWPLDRYRVVKVARKHSETVLTVWMSGLIRTRAAGEQQQPPSLVGTGV

SEQ ID NO: 1539 - protein, 56 aa, Human herpesvirus 5
QHYLVPPNGRRACLNPDHHLSKWLDAQNSNSWYKVVVTTGGGGGPHVDKKAEIKKR

SEQ ID NO: 1540 - protein, 56 aa, Human herpesvirus 5
QLKLEILRQLETTISTKYNVSKQPVKNLTMNMTEFPQYYILAGPIQNYSITYLWFD

SEQ ID NO: 1541 - protein, 56 aa, Rhinovirus A
NPIENYVDEVLNEVLVVPNINSSHPTTSNSAPALDAAETGHTSNVQPEDVIETRYV

SEQ ID NO: 1542 - protein, 56 aa, Rhinovirus A
NPVENYIDSVLNEVLVVPNIQPSTSVSSHAAPALDAAETGHTSSVQPEDMIETRYV

SEQ ID NO: 1543 - protein, 56 aa, Rhinovirus A
TDMHVQNVPITQNPVENYIDEVLNEVLVVPNIRESHPTTSNAATALDAAETGHTSS

SEQ ID NO: 1544 - protein, 56 aa, Rhinovirus A
KGIIAQNPIENYVDEVLNEVLVVPNINSSHPTTSNSAPALDAAETGHTSNVQPEDV

SEQ ID NO: 1545 - protein, 56 aa, Rhinovirus A; identical to SEQ ID NO: 38

SEQ ID NO: 1546 - protein, 56 aa, Rhinovirus A
RDTNLHTQEGVLTQNPVENYIDSVLNEVLVVPNIQPSTSVSSHAAPALDAAETGHT

SEQ ID NO: 1547 - protein, 56 aa, Rhinovirus A
TNLHMQKGIIAQNPIENYVDEVLNEVLVVPNINSSHPTTSNSAPALDAAETGHTSN

SEQ ID NO: 1548 - protein, 56 aa, Rhinovirus A
RDTDLHIQSGPIEQNPVENYIDEVLNEVLVVPNIKESHHTTSNSAPLLDAAETGHT

SEQ ID NO: 1549 - protein, 56 aa, Rhinovirus A
LHIQSGPIEQNPVENYIDEVLNEVLVVPNIKESHHTTSNSAPLLDAAETGHTSNVQ

SEQ ID NO: 1550 - protein, 56 aa, Rhinovirus A
TPNTAEMLCFVSGCKDFCLRMARDTDLHKQTGPITQNPVERYVDEVLNEVLVVPNI

SEQ ID NO: 1551 - protein, 56 aa, Rhinovirus A
TDMHKQDDAIEQNPVENYVGEALNEVLVVPNIKESHPSTSNSAPILDAAETGHTSN

SEQ ID NO: 1552 - protein, 56 aa, Rhinovirus A
PNTPQTADMLCFVSACKDFCLRMARDTDLHIQSGPIEQNPVENYIDEVLNEVLVVP

SEQ ID NO: 1553 - protein, 56 aa, Rhinovirus A
QSGAIAQNPVENYIDEVLNEVLVVPNINSSNPTTSNSAPALDAAETGHTSSVQPED

SEQ ID NO: 1554 - protein, 56 aa, Rhinovirus A
SSNPTTSNSAPALDAAETGHTSSVQPEDVIETRYVQTSQTRDEMSLESFLGRSGCI

SEQ ID NO: 1555 - protein, 56 aa, Rhinovirus A
STARLLCFVSGCKDFCLRMARDTNLHMQKGIIAQNPIENYVDEVLNEVLVVPNINS

SEQ ID NO: 1556 - protein, 56 aa, Rhinovirus A
FVVPDSTPDNAKMVCMVSACKDFCLRLARDTNLHTQEGVLTQNPVENYIDSVLNEV

SEQ ID NO: 1557 - protein, 56 aa, Rhinovirus A
PPTARLLCFVSGCKDFCLRMARDTNLHLQSGAIAQNPVENYIDEVLNEVLVVPNIN

SEQ ID NO: 1558 - protein, 56 aa, Rhinovirus A
NSAPALDAAETGHTSNVQPEDVIETRYVQTSQTRDEMSLESFLGRSGCIHESKLKV

SEQ ID NO: 1559 - protein, 56 aa, Rhinovirus A
PEHQLASATSGNVSVGYNHTHPGEQGREVVPSRSSSDNKRPSDDSWLNFDGTLLGN

SEQ ID NO: 1560 - protein, 56 aa, Rhinovirus A
PEHQLANANATNADAGYNYTHPGERGREVGSDRVAHANLPSDDNWLNFDGTLLGNA

SEQ ID NO: 1561 - protein, 56 aa, Rhinovirus A
DKRRRQVIDVMSAIFQGPISLQNPPPPAIADLLQSVRTPEVIKYCEENKWIIPAEC

SEQ ID NO: 1562 - protein, 56 aa, Rhinovirus A
PEHQIASLQHGDVNVGYNFTHPGEEGREVKNTTREHLQQQPTEEHWLNFDGTLLGN

SEQ ID NO: 1563 - protein, 56 aa, Rhinovirus A
PEHQLASANYGNVTAGYNYTHPGEAGRDVGQQRTNNEKQPSDDNWLNFDGTLLGNL

SEQ ID NO: 1564 - protein, 56 aa, Rhinovirus A
TPCKTKLQPSVFYDVFPGSKEPAVLSEKDARLQVDFNEALFSKYKGNTDCSINDHI

SEQ ID NO: 1565 - protein, 56 aa, Rhinovirus A
LVVPPSTPQTADMLCFVSACKDFCLRMARDTDLHIQSGPIEQNPVENYIDEVLNEV

SEQ ID NO: 1566 - protein, 56 aa, Rhinovirus A
LYSHIKEEDRRRSSAAQAMEAIFQGIDLQSPPPPAIADLLRSVKTPEIIKYCQDNN

SEQ ID NO: 1567 - protein, 56 aa, Rhinovirus A
DGYDQQSVVIMDDIMQNPSGEDMTLFCQMVSSVPFIPPMADLPDKGKPFTSKFVLA

SEQ ID NO: 1568 - protein, 56 aa, Rhinovirus A
DVMSAIFQGPIDMKNPPPPAITDLLQSVRTPEVIKYCEENRWIIPAECKIEKELNL

SEQ ID NO: 1569 - protein, 56 aa, Rhinovirus A
EDKRRRQVVDVMAAIFQGPITLEGPPPAAINDLLKSVRTPEVIKYCEDNKWIVPAE

SEQ ID NO: 1570 - protein, 56 aa, Rhinovirus A
HAAPALDAAETGHTSSVQPEDMIETRYVITDQTRDETSIESFLGRSGCIAMIEFNT

SEQ ID NO: 1571 - protein, 56 aa, Rhinovirus A
IPPDTPSTARLLCFVSGCKDFCLRMARDTNLHMQKGIIAQNPIENYVDEVLNEVLV

SEQ ID NO: 1572 - protein, 56 aa, Rhinovirus A
SHPTTSNSAPALDAAETGHTSNVQPEDVIETRYVQTSQTRDEMSLESFLGRSGCIH

SEQ ID NO: 1573 - protein, 56 aa, Rhinovirus A
PEHQLATVNKGNVNAGYKYTHPGEAGREVGTQVENEKQPSDDNWLNFDGTLLGNLL

SEQ ID NO: 1574 - protein, 56 aa, Rhinovirus A
VAMIPEHQLASAKHGSVTAGYKLTHPGEAGRDVSQERDASLRQPSDDSWLNFDGTL

SEQ ID NO: 1575 - protein, 56 aa, Rhinovirus A
NINYFKDAASSGASKLEFSHDPSKFTDPVKDVLEKGIPTLQSPTVEACGYSDRIMQ

SEQ ID NO: 1576 - protein, 56 aa, Rhinovirus A
PEHQLASATSGNVSVGYNHTHPGEQGREVVPSRTSSDNKRPSDDSWLNFDGTLLGN

SEQ ID NO: 1577 - protein, 56 aa, Rhinovirus A
NINYFKDAASSGASRLDFSQDPSKFTDPVKDVLEKGIPTLQSPTVEACGYSDRLIQ

SEQ ID NO: 1578 - protein, 56 aa, Rhinovirus A
PEHQIASALHGNVNVGYNYTHPGETGREVKAETRLNPDLQPTEEYWLNFDGTLLGN

SEQ ID NO: 1579 - protein, 56 aa, Rhinovirus A
DKRRRQVVDVMSAIFQGPISLDAPPPPAIADLLQSVRTPEVIKYCQDNKWIVPAEC

SEQ ID NO: 1580 - protein, 56 aa, Rhinovirus A
VPNINSSHPTTSNSAPALDAAETGHTSNVQPEDVIETRYVQTSQTRDEMSLESFLG

SEQ ID NO: 1581 - protein, 56 aa, Rhinovirus A
NINYFKDAASNGASKLEFSQDPSKFTDPVKDVLEKGIPTLQSPTVEACGYSDRIIQ

SEQ ID NO: 1582 - protein, 56 aa, Rhinovirus A
FPPNTPNRADMLCFVSACKDFCLRMARDTDMHKQDDAIEQNPVENYVGEALNEVLV

SEQ ID NO: 1583 - protein, 56 aa, Rhinovirus A
NPAGDDMTLFCQMVSSVTFIPPMADLPDKGKAFDSRFVLCSTNHSLLTPPTITSLP

SEQ ID NO: 1584 - protein, 56 aa, Rhinovirus A
PTGDDMTLFCQMVSSVTFIPPMADLPDKGKAFDSRFVLCSTNHSLLAPPTITSLPA

SEQ ID NO: 1585 - protein, 56 aa, Rhinovirus A
IMDDIMQNPTGEDMTLFCQMVSSVTFIPPMADLPDKGKAFDSRFVLCSTNHSLLAP

SEQ ID NO: 1586 - protein, 56 aa, Rhinovirus A
QSPPPPAIADLLRSVKTPEIIKYCQDNNWIVPAECSIERDLGIANMTIGIIANVVS

SEQ ID NO: 1587 - protein, 56 aa, Rhinovirus A
NQSHPTTSNAAPVLDAAETGHTNKIQPEDTIETRYVQSSQTLDEMSVESFLGRSGC

SEQ ID NO: 1588 - protein, 56 aa, Rhinovirus A
DIYSLPPDPKYFDGYDQQSVVIMDDIMQNPAGDDMTLFCQMVSSVTFIPPMADLPD

SEQ ID NO: 1589 - protein, 56 aa, Rhinovirus A
NINYFKDAASNGASKLEFTQDPSKFTDPVKDVLEKGIPTLQSPTVEACGYSDRIIQ

SEQ ID NO: 1590 - protein, 56 aa, Rhinovirus A
MVSSVPFIPPMADLPDKGKPFTSKFVLASTNHTLLTPPTVSSLPAMARRFYFDLDI

SEQ ID NO: 1591 - protein, 56 aa, Rhinovirus A
VDVMTAIFQGPIDMKNPPPPAITDLLQSVRTPEVIKYCEGNRWIIPAECKIEKELN

SEQ ID NO: 1592 - protein, 56 aa, Rhinovirus A
SIHTPTKTKLQPSVFYDIFPGSKEPAVLTEKDPRLKVDFDSALFSKYKGNTECSLN

SEQ ID NO: 1593 - protein, 56 aa, Rhinovirus A
LVVPNIQPSTSVSSHAAPALDAAETGHTSSVQPEDMIETRYVITDQTRDETSIESF

SEQ ID NO: 1594 - protein, 56 aa, Rhinovirus A
VIMDDIMQNPSGEDMTLFCQMVSSVTFIPPMADLPDKGKPFDSRFVLCGTNHNLLA

SEQ ID NO: 1595 - protein, 56 aa, Rhinovirus A
VPNIRESHPTTSNAATALDAAETGHTSSIQPEDTIETRYVQTSHTRDEMSVESFLG

SEQ ID NO: 1596 - protein, 56 aa, Rhinovirus A
KELPVSVKNLPSVHVSSKTRLQPSVFHDVFPGTKEPAVLSSNDPRLETDFDSALFS

SEQ ID NO: 1597 - protein, 56 aa, Rhinovirus A
IMDDIMQNPDGEDMTLFCQMVSSVTFIPPMADLPDKGKPFDSRFVLCSTNHSLLAP

SEQ ID NO: 1598 - protein, 56 aa, Rhinovirus A
FPPNTPNNANMICFVSGCKDFCLRMARDTDMHVQNVPITQNPVENYIDEVLNEVLV

SEQ ID NO: 1599 - protein, 56 aa, Rhinovirus A
LRSYFADTQGQITLSKRTSECNLPSIHNPCKTKLQPSVFYDVFPGSKEPAVLSDKD

SEQ ID NO: 1600 - protein, 41 aa, Rhinovirus A
NINYFKDAASNGASKLEFSQDPSKFTDPVKDVLEKGIPTLQ

SEQ ID NO: 1601 - protein, 56 aa, Rhinovirus A
PCKTKLQPSVFYDVFPGSKEPAVLSDKDTRLQVDFNESLFSKYKGNTHCVMNEHIK

SEQ ID NO: 1602 - protein, 56 aa, Rhinovirus A
NINYFKDAASSGASRLDFSQDPSKFTDPVKDVLEKGIPTLQSPSVEACGYSDRIIQ

SEQ ID NO: 1603 - protein, 56 aa, Rhinovirus A
MGAQVSRQNVGTHSTQNSVSNGSSLNYFNINYFKDAASNGASKLEFSQDPSKFTDP

SEQ ID NO: 1604 - protein, 56 aa, Rhinovirus A
IYSLPPDPKYFDGYDQQSVVIMDDIMQNPTGDDMTLFCQMVSSVTFIPPMADLPDK

SEQ ID NO: 1605 - protein, 56 aa, Rhinovirus A
RQVVDVMSAIFQGPISMDKPPPPAITDLLRSVRTPEVIKYCQDNKWIVPADCQIER

SEQ ID NO: 1606 - protein, 56 aa, Rhinovirus A
ECNLPSIHTPSKIKLQPSVFYDVFPGSKEPAVLSEFDPRLEVDFKQALFSKYKGNN

SEQ ID NO: 1607 - protein, 56 aa, Rhinovirus A
CGLPSIHNPSKTKLQPSVFYDIFPGSKQPAVLSEKDTRLQVDFNEALFSKYKGNVD

SEQ ID NO: 1608 - protein, 56 aa, Rhinovirus A
ITRGDSTITSQDIANAVVAYGVWPSYLTPDDATAIDKPTQPDTSSNRFYTLDSRSW

SEQ ID NO: 1609 - protein, 56 aa, Rhinovirus A
CGLPTIHTPSKTKLQPSVFYDVFPGSKEPAVSRDNDPRLKVNFKEALFSKYKGNTE

SEQ ID NO: 1610 - protein, 56 aa, Rhinovirus A
PEHQLASAKNGSVTAGYNLTHPGEAGRVVGQQRDANLRQPSDDSWLNFDGTLLGNL

SEQ ID NO: 1611 - protein, 56 aa, Rhinovirus A
ITRGDSTITSQDVANAVVGYGVWPHYLTPQDATAIDKPTQPDTSSNRFYTLDSKMW

SEQ ID NO: 1612 - protein, 56 aa, Rhinovirus A
AIVIHGPPGAGKSITTNFLAKMITNDSDIYSLPPDPKYFDGYDQQSVVIMDDIMQN

SEQ ID NO: 1613 - protein, 56 aa, Rhinovirus A
SECNLPSIHNPCKTKLQPSVFYDVFPGSKEPAVLSDKDTRLQVDFNESLFSKYKGN

SEQ ID NO: 1614 - protein, 56 aa, Rhinovirus A
KELPVSVKNLPSIHVSSKTRLQPSVFHDVFPGTKEPAVLSSNDPRLETDFDSALFS

SEQ ID NO: 1615 - protein, 56 aa, Rhinovirus A
QKKRSEPVAIVVHGPPGTGKSITTSFLARMITNDSDIYSLPPDPKYFDGYDQQSVV

SEQ ID NO: 1616 - protein, 56 aa, Rhinovirus A
PPMADLPDKGKPFDSRFVLCGTNHNLLAPPTITSLPAMNRRFFLDLDIVACDKYKD

SEQ ID NO: 1617 - protein, 56 aa, Rhinovirus A
KSLATSVLARMLTVETDIYSLPPDPKYFDGYDQQSVVIMDDIMQNPSGEDMTLFCQ

SEQ ID NO: 1618 - protein, 56 aa, Rhinovirus A
AKHVKAWCPRAPRAVPYTHSNVTNYKVRDGEPTLFIKPRENLTTAGPSDMYVHVGN

SEQ ID NO: 1619 - protein, 56 aa, Rhinovirus A
RDGFSAMLLRSYFTDTQGQITLSKKTSECGLPSIHNPSKTKLQPSVFYDIFPGSKQ

SEQ ID NO: 1620 - protein, 56 aa, Rhinovirus A
MGAQVSRQNVGTHSTQNSVSNGSSLNYFNINYFKDAASSGASRLDFSQDPSKFTDP

SEQ ID NO: 1621 - protein, 56 aa, Rhinovirus A
NESDIYSLPPDPKYFDGYDNQSVVIMDDIMQNPGGEDMTLFCQMVSSVTFIPPMAD

SEQ ID NO: 1622 - protein, 56 aa, Rhinovirus A
RDGFSAMLLRSYFTDTQGQIKISKHANECGLPTIHTPSKTKLQPSVFYDVFPGSKE

SEQ ID NO: 1623 - protein, 56 aa, Rhinovirus A
SSMLLRSYFTEQQGQIQISKHVKDVGLPSIHTPTKTKLQPSVFYDIFPGSKEPAVL

SEQ ID NO: 1624 - protein, 56 aa, Rhinovirus A
ITRGDSTITSQDTANAVVAYGVWPSYLTPDDATAIDKPTQPDTSSNRFYTLDSRSW

SEQ ID NO: 1625 - protein, 56 aa, Rhinovirus A
IMQNPGGEDMTLFCQMVSSVTFIPPMADLPDKGKPFDSRFVLCSTNHSLLAPPTIS

SEQ ID NO: 1626 - protein, 56 aa, Rhinovirus A
LLRSYFTDVQGQITLSKKTSECNLPSIHTPCKTKLQPSVFYDVFPGSKEPAVLSEK

SEQ ID NO: 1627 - protein, 56 aa, Rhinovirus A; identical to SEQ ID NO: 1602

SEQ ID NO: 1628 - protein, 56 aa, Rhinovirus A
NIKESHHTTSNSAPLLDAAETGHTSNVQPEDAIETRYVMTSQTRDEMSIESFLGRS

SEQ ID NO: 1629 - protein, 56 aa, Rhinovirus A; identical to SEQ ID NO: 1620

SEQ ID NO: 1630 - protein, 56 aa, Rhinovirus A
LVVPNIKESHHTTSNSAPLLDAAETGHTSNVQPEDAIETRYVITSQTRDEMSIESF

SEQ ID NO: 1631 - protein, 56 aa, Rhinovirus A
NINYFKDAASSGASKLEFSQDPSKFTDPVKDVLEKGIPTLQSPTVEACGYSDRIIQ

SEQ ID NO: 1632 - protein, 56 aa, Rhinovirus A
VPNIKESHPSTSNSAPILDAAETGHTSNVQPEDTIETRYVQTTQTRDEMSIESFLG

SEQ ID NO: 1633 - protein, 56 aa, Rhinovirus A
KQKKRCEPVAVAIHGEPGTGKSMTTNFLARMITNDSDIYSLPPDPKYFDGYDQQSV

SEQ ID NO: 1634 - protein, 56 aa, Rhinovirus A
SEPVAVMIHGPPGTGKSITTSFLARMITNESDIYSLPPDPKYFDGYDNQSVVIMDD

SEQ ID NO: 1635 - protein, 56 aa, Rhinovirus A
GIKKRDLINNKTKDISRLKQAIDKYGVDLPMVTFLKDELRKEEKIAKGKTRVIEAS

SEQ ID NO: 1636 - protein, 56 aa, Rhinovirus A
INNKTKDISKLKEAIDKYGVDLPMVTFLKDELRKHEKVIKGKTRVIEASSVNDTLL

SEQ ID NO: 1637 - protein, 56 aa, Rhinovirus A
ITRGDSTITSQDVANAVVGYGVWPHYLSAKDATAIDKPTQPDTSSNRFYTLDSKIW

SEQ ID NO: 1638 - protein, 56 aa, Rhinovirus A
NGRDGFSAMLLRSYFADTQGQITLSKRTSECNLPSIHNPCKTKLQPSVFYDVFPGS

SEQ ID NO: 1639 - protein, 56 aa, Rhinovirus A
KDLINNKTKDISKLKLALDKYDVDLPMITFLKDELRKKDKIAAGKTRVIEASSIND

SEQ ID NO: 1640 - protein, 56 aa, Rhinovirus A
MGAQVSRQNVGTHSTQNSVSNGSSLNYFNINYFKDAASNGASKLEFTQDPSKFTDP

SEQ ID NO: 1641 - protein, 56 aa, Rhinovirus A
QRKRSEPVAVMIHGPPGTGKSITTNFLARMITNESDVYSLPPDPKYFDGYDNQSVV

SEQ ID NO: 1642 - protein, 56 aa, Rhinovirus A
MGAQVSRQNVGTHSTQNMVSNGSSLNYFNINYFKDAASSGASRLDFSQDPSKFTDP

SEQ ID NO: 1643 - protein, 56 aa, Rhinovirus A
MGIKKRDLINKQTRDITKLKMALDKYGVDLPMVTLLKDELRKKEKISAGKTRVIEA

SEQ ID NO: 1644 - protein, 40 aa, Rhinovirus A
PRPPRAVAYQHTHSTNYIPSNGEATTQIKTRPDVFTVTNV

SEQ ID NO: 1645 - protein, 56 aa, Rhinovirus A
NNKTKDISKLREALDKYGVDLPMVTFLKDELRKQEKIIKGKTRVIEASSVNDTLLF

SEQ ID NO: 1646 - protein, 56 aa, Rhinovirus A
TDGLEALDLNTSAGFPYITMGIKKRDLINNKTKDISKLREALDKYGVDLPMVTFLK

SEQ ID NO: 1647 - protein, 56 aa, Rhinovirus A
KDRNSCNKYSLAQVYNIMIEEDRRRRQVVDVMTAIFQGPIDMKNPPPPAITDLLQS

SEQ ID NO: 1648 - protein, 56 aa, Rhinovirus A
RMITNDSDIYSLPPDPKYFDGYDQQSVVIMDDIMQNPTGEDMTLFCQMVSSVTFIP

SEQ ID NO: 1649 - protein, 56 aa, Rhinovirus A
DRNSCNKYTLAQIYNIMLEEDRRRRQMVDVMSAIFQGPIDMKNPPPPAITDLLQSV

SEQ ID NO: 1650 - protein, 56 aa, Rhinovirus A
AWCPRPPRAVQYSHTHTTNYKLSSEVHNDVAIRPRTNLTTVGPSDMYVHVGNLIYR

SEQ ID NO: 1651 - protein, 56 aa, Rhinovirus A
PMADLPDKGKPFDSRFVLCSTNHSLLAPPTISSLPAMNRRFFFDLDIVVHDNYKDA

SEQ ID NO: 1652 - protein, 56 aa, Rhinovirus A
TNYIPLNGEATTQIKTRPDVFTITNVGPSSMFVHVGNLIYRNLHLFNSDLDDSILV

SEQ ID NO: 1653 - protein, 56 aa, Rhinovirus A
MGAQVSRQNVGTHSTQNMVSNGSSLNYFNINYFKDAASSGASKLEFSHDPSKFTDP

SEQ ID NO: 1654 - protein, 56 aa, Rhinovirus A
VFPGTKEPAVLSSNDPRLETDFDSALFSKYKGNPACQVTPHMKIAVAHYAAQLSTL

SEQ ID NO: 1655 - protein, 56 aa, Rhinovirus A
KEPAVLSDKDTRLQVDFNESLFSKYKGNTHCVMNEHIKIASAHYAAQLITLDIDPN

SEQ ID NO: 1656 - protein, 56 aa, Rhinovirus A
GFPYVSLGIKKKDLIDKKTKDITKLRKAIDEYGIDLPMVTFLKDELRKKEKIKDGK

SEQ ID NO: 1657 - protein, 56 aa, Rhinovirus A
ALEDSVFGIEGLEALDLNTSAGFPYVTMGIKKRDLINNKTKDISRLKEALDKYGVD

SEQ ID NO: 1658 - protein, 56 aa, Rhinovirus A
ARMITNDSDIYSLPPDPKYFDGYDQQSVVIMDDIMQNPSGEDMTLFCQMVSSVTFI

SEQ ID NO: 1659 - protein, 56 aa, Rhinovirus A
TMGIKKRDLINNKTKDISKLREALDKYGVDLPMVTFLKDELRKQEKIIKGKTRVIE

SEQ ID NO: 1660 - protein, 56 aa, Rhinovirus A
RMITNESDVYSLPPDPKYFDGYDNQSVVIMDDIMQNPDGEDMTLFCQMVSSVTFIP

SEQ ID NO: 1661 - protein, 56 aa, Rhinovirus A
CRIYHKAKHIKAWCPRPPRAVAYQHTHSTNYIPLNGEATTQIKTRPDVFTITNVGP

SEQ ID NO: 1662 - protein, 56 aa, Rhinovirus A
GIKKRDLINNKTKDISRLKEALDKYGVDLPMITFLKDELRKKEKISAGKTRVIEAS

SEQ ID NO: 1663 - protein, 56 aa, Rhinovirus A
ITRGDSTITSQDVANAVVAYGVWPHYLSSEDATAIDKPSRPDTSSNRFYTLKSITW

SEQ ID NO: 1664 - protein, 56 aa, Rhinovirus A
AKHTKAWCPRPPRAVPYTHSRVTNYVPKTGDVTTAIVPRASMKTVGPSDLYVHVGN

SEQ ID NO: 1665 - protein, 56 aa, Rhinovirus A
SVFGMDGLEALDLNTSAGYPYVTLGIKKKDLINNKTKDISKLKLALDKYDVDLPMI

SEQ ID NO: 1666 - protein, 56 aa, Rhinovirus A
ISLEDSVFGTEGLEALDLTTSAGFPYVSMGIKKRDLINKQTRDITKLKMALDKYGV

SEQ ID NO: 1667 - protein, 56 aa, Rhinovirus A
GFPYVSLGIKKKDLIDKKTRDITKLKKAIDEYGIDLPMVTFLKDELRKKEKIKDGK

SEQ ID NO: 1668 - protein, 56 aa, Rhinovirus A
YLGRSGYTVHVQCNATKFHQGTLVVAMIPEHQIASLQHGDVNVGYNFTHPGEEGRE

SEQ ID NO: 1669 - protein, 56 aa, Rhinovirus A
FLGRSGYTVHVQCNASKFHQGTLLVAMIPEHQLASAKNGSVTAGYNLTHPGEAGRV

SEQ ID NO: 1670 - protein, 56 aa, Rhinovirus A
FLGRSGYTIHVQCNSSKFHQGLLIVAAIPEHQLASATSGNVSVGYNHTHPGEQGRE

SEQ ID NO: 1671 - protein, 56 aa, Rhinovirus A
CRIYHKAKHIKAWCPRPPRAVAYQHTHSTNYIPSNGEATTQIKTRPDVFTVTNVGP

SEQ ID NO: 1672 - protein, 56 aa, Rhinovirus A
GDNHVAFIDLRHFHCAEEQGVTDYIHMLGEAFGNGFVDSVKEHVKAINPVGNISKK

SEQ ID NO: 1673 - protein, 56 aa, Rhinovirus A
GGEGHVAFIDLRQFHCADEQGITDYIHMLGEAFGSGFVDSVKGQINAINPINNISK

SEQ ID NO: 1674 - protein, 56 aa, Rhinovirus A
ITRGDSTITSQDVANAIVAYGVWPHYLSSKDASAIDKPSQPDTSSNRFYTLRSVTW

SEQ ID NO: 1675 - protein, 56 aa, Rhinovirus A
GFPYVSLGIKKKDLIDKRTRDITKLKKAIDEYGIDLPMVTFLKDELRKKEKIKDGK

SEQ ID NO: 1676 - protein, 56 aa, Rhinovirus A
MGAQVSRQNVGTHSTQNSVSGGSSLNYFNINYFKDAASSGASKLEFSQDPSKFTDP

SEQ ID NO: 1677 - protein, 31 aa, Rhinovirus A
LEYTRAHRTNFKIEGENVKSRVAHRPAVITA

SEQ ID NO: 1678 - protein, 56 aa, Rhinovirus A
PITLEDSVFGTDGLEALDLNTSAGFPYITMGIKKRDLINNKTKDISKLREALDKYG

SEQ ID NO: 1679 - protein, 56 aa, Rhinovirus A
EPAVLSEFDPRLEVDFKQALFSKYKGNNQCEINDHVRVAISHYSAQLMTLDIDSSP

SEQ ID NO: 1680 - protein, 56 aa, Rhinovirus A
ITRGDSTITSQDVANAVVGYGVWPHYLTPQDATAIDKPTQPDTSSNRFYTLESKHW

SEQ ID NO: 1681 - protein, 56 aa, Rhinovirus A
GTDGLEALDLNTSAGFPYIAMGVKKRDLINNKTKDISKLKEAIDKYGVDLPMVTFL

SEQ ID NO: 1682 - protein, 56 aa, Rhinovirus A
RIASSHYAAQLITLDIDPKPITLEDSVFGTDGLEALDLNTSAGFPYIAMGVKKRDL

SEQ ID NO: 1683 - protein, 56 aa, Rhinovirus A
DINPQPLSLEESVFGIEGLEALDLNTSAGFPYVSLGIKKKDLIDKKTKDITKLRKA

SEQ ID NO: 1684 - protein, 56 aa, Rhinovirus A
DINPQPLSLEESVFGIEGLEALDLNTSAGFPYVSLGIKKKDLIDKKTRDITKLKKA

SEQ ID NO: 1685 - protein, 56 aa, Rhinovirus A
TLEDGVFGTEGLEALDLNTSAGFPYITMGIKKRDLINNKTKDISRLKQAIDKYGVD

SEQ ID NO: 1686 - protein, 56 aa, Rhinovirus A
GEGHVAFTDLRQFQCAEEQGITDYIHMLGEAFGNGFVDSVKEQINAINPINSISKK

SEQ ID NO: 1687 - protein, 29 aa, Rhinovirus A
SSKIRSVSAGRALYIPPYDLLKHEWYEKF

SEQ ID NO: 1688 - protein, 56 aa, Rhinovirus A
AKDATAIDKPTQPDTSSNRFYTLDSKIWKPGSKGWWWKLPDALKEMGIFGENMHYH

SEQ ID NO: 1689 - protein, 56 aa, Rhinovirus A
VAIVIHGPPGAGKSITTNFLAKMITNDSDIYSLPPDPKYFDGYDQQSVVIMDDIMQ

SEQ ID NO: 1690 - protein, 56 aa, Rhinovirus A
GRDGFAAMLLRSYFSETQGQITTTKPTIECNLPSIHTPSKIKLQPSVFYDVFPGSK

SEQ ID NO: 1691 - protein, 56 aa, Rhinovirus A
TNYIPSNGEATTQIKTRPDVFTVTNVGPSSMFVHVGNLIYRNLHLFNSDLDDSILV

SEQ ID NO: 1692 - protein, 56 aa, Rhinovirus A
DINPQPLSLEESVFGIEGLEALDLNTSAGFPYVSLGIKKKDLIDKRTRDITKLKKA

SEQ ID NO: 1693 - protein, 56 aa, Rhinovirus A
YIKCSNVIKGGKRNEPVAVLIHGSPGTGKSLATSVLARMLTVETDIYSLPPDPKYF

SEQ ID NO: 1694 - protein, 56 aa, Rhinovirus A
VTFKDRNTCRTYSLSQIYNQILEEDKRRRQVVDVMSAIFQGPISMDKPPPPAITDL

SEQ ID NO: 1695 - protein, 56 aa, Rhinovirus A
HVKAWCPRPPRALEYTRAHRTNFKIEGENVKSRVAHRPAVITAGPSDMYVHVGNLI

SEQ ID NO: 1696 - protein, 56 aa, Rhinovirus A
IADLLQSVRTPEVIKYCEENKWIIPAECKIEKELNLANTIITIIANVINIAGIIYV

SEQ ID NO: 1697 - protein, 56 aa, Rhinovirus A
QGPYSGEPKIKTKIPERRVVAQGPEGEFGMSLIKHNSCVVTTENGKFTGLGIYDRT

SEQ ID NO: 1698 - protein, 44 aa, Rhinovirus A
CHLMWHNGRDAYKGFVEKIRSVSAGRMLYIPPYDLLLHEWYEKF

SEQ ID NO: 1699 - protein, 56 aa, Rhinovirus A
AINDLLKSVRTPEVIKYCEDNKWIVPAECKVERDLNIANTVITIIANIISISGIIY

SEQ ID NO: 1700 - protein, 56 aa, Rhinovirus A
PMADLPDKGKAFDSRFVLCSTNHSLLAPPTITSLPAMNRRFFLDLDIIVHDNYKDA

SEQ ID NO: 1701 - protein, 56 aa, Rhinovirus A
CPRPPRALEYTRAHRTNFKIEDRSIQTAIVTRPIITTAGPSDMYVHVGNLIYRNLH

SEQ ID NO: 1702 - protein, 56 aa, Rhinovirus A
YLGRSGYTIHVQCNASKFHQGTLIVALIPEHQIASALHGNVNVGYNYTHPGETGRE

SEQ ID NO: 1703 - protein, 56 aa, Rhinovirus A
KVLDSYDLYNKDGVKLEITVLKLDRNEKFRDIRKYIPENEDDYPECNLALSANQPE

SEQ ID NO: 1704 - protein, 56 aa, Rhinovirus A
YLGRSGYTVHVQCNASKFHQGTLLILMIPEHQLANANATNADAGYNYTHPGERGRE

SEQ ID NO: 1705 - protein, 56 aa, Rhinovirus A
HVKAWCPRPPRAVPYRYVGSTNYKKPDQEDVTIFIERRQDPKFITTGPSDLFVHVG

SEQ ID NO: 1706 - protein, 56 aa, Rhinovirus A
VRTPEVIKYCEGNRWIIPAECKIEKELNLANTIITIIANVIGMARIIYVIYKLFCT

SEQ ID NO: 1707 - protein, 56 aa, Rhinovirus A
MYYHFLGRSGYTVHVQCNASKFHQGTLLVAMIPEHQLASAKHGSVTAGYKLTHPGE

SEQ ID NO: 1708 - protein, 56 aa, Rhinovirus A
LCSRIVTSEQLHKVKVVTRIYHKAKHTKAWCPRPPRAVQYSHTHTTNYKLSSEVHN

SEQ ID NO: 1709 - protein, 56 aa, Rhinovirus A
DLPMVTLLKDELRKKEKISAGKTRVIEASSVNDTVLFRTTFGNLFSKFHLNPGIVT

SEQ ID NO: 1710 - protein, 56 aa, Rhinovirus A
PRPPRALEYTRAHRTNFKIEGENVKSRVAHRPAVITAGPSDMYVHVGNLIYRNLHL

SEQ ID NO: 1711 - protein, 56 aa, Rhinovirus A
ICGKAVIFRDRNNCQTYTLAQVYNQILTEDKRRRQVVDVMAAIFQGPITLEGPPPA

SEQ ID NO: 1712 - protein, 56 aa, Rhinovirus A
FCSLQGPYSGEPKPKTKVPERRVVAQGPEEEFGMSIIKNNTCVVTTTNGKFTGLGI

SEQ ID NO: 1713 - protein, 56 aa, Rhinovirus A
ADDASAIDKPTQPDTSSNRFYTLESKVWKRDSKGWWWKLPDALKDMGIFGENMYYH

SEQ ID NO: 1714 - protein, 56 aa, Rhinovirus A
PPTITSLPAMNRRFFLDLDIVACDKYKDPQGKLNVAAAFQPCDVNTKIGNARCCPF

SEQ ID NO: 1715 - protein, 56 aa, Rhinovirus A
FLGRSGYTVHVQCNASKFHQGTLLIAMVPEHQLASANYGNVTAGYNYTHPGEAGRD

SEQ ID NO: 1716 - protein, 56 aa, Rhinovirus A
SMLPQAQLKVKYLNELKKLNLYEKQVESLRVADMKTQEKIKMEIDTLHDLSRKFLP

SEQ ID NO: 1717 - protein, 56 aa, Rhinovirus A
PTISSLPAMNRRFFFDLDIVVHDNYKDAQGKLNVSKAFQPCNVNTKIGNAKCCPFV

SEQ ID NO: 1718 - protein, 56 aa, Rhinovirus A
IHVGGNGRDGFSAMLLKSYFGETQGLITKELPVSVKNLPSVHVSSKTRLQPSVFHD

SEQ ID NO: 1719 - protein, 56 aa, Rhinovirus A
TRLQVDFNESLFSKYKGNTHCVMNEHIKIASAHYAAQLITLDIDPNPITLEDSVFG

SEQ ID NO: 1720 - protein, 56 aa, Rhinovirus A
TFLKDELRKKDKIAAGKTRVIEASSINDTILFRTVYGNLFSKFHLNPGVVTGCAVG

SEQ ID NO: 1721 - protein, 56 aa, Rhinovirus A
DLRQFHCADEQGITDYIHMLGEAFGNGFVDSVKEHVHAINPIGNISKKIVKWMLRI

SEQ ID NO: 1722 - protein, 56 aa, Rhinovirus A
PAVLSEKDTRLQVDFNEALFSKYKGNVDCPMNDHIKIASSHYAAQLITLDINPNPI

SEQ ID NO: 1723 - protein, 56 aa, Rhinovirus A
TITPADKSSEFKELDYGNVTFLKRGFRQDDKYKFLIHPTFPVEEIYESIRWTKKPS

SEQ ID NO: 1724 - protein, 56 aa, Rhinovirus A
IGFPSQLINQICNSKHIYKSKYYEVEGGMPSGCAGTSIFNTIINNIIIRTLVLDAY

SEQ ID NO: 1725 - protein, 56 aa, Rhinovirus A
CGKAVSFKDRNSCNKYTLAQIYNIMLEEDKRRRQVIDVMSAIFQGPISLQNPPPPA

SEQ ID NO: 1726 - protein, 56 aa, Rhinovirus A
PDDATAIDKPTQPDTSSNRFYTLDSRSWTSASSGWWWKLPDALKNMGIFGENMFYH

SEQ ID NO: 1727 - protein, 56 aa, Rhinovirus A
VKDVLEKGIPTLQSPTVEACGYSDRLIQITRGDSTITSQDTANAVVAYGVWPSYLT

SEQ ID NO: 1728 - protein, 56 aa, Rhinovirus A
PQDATAIDKPTQPDTSSNRFYTLDSKMWNSTSKGWWWKLPDALKDMGIFGENMFYH

SEQ ID NO: 1729 - protein, 56 aa, Rhinovirus A
PQDATAIDKPTQPDTSSNRFYTLESKHWNGDSKGWWWKLPDALKEMGIFGENMYYH

SEQ ID NO: 1730 - protein, 56 aa, Rhinovirus A
IYKLFCTLQGPYSGEPKPKTKIPERRVVAQGPEEEFGRSLIKHNSCVVTTQNGKFT

SEQ ID NO: 1731 - protein, 56 aa, Rhinovirus A
LLANQDEPTIISVGDAESYGNILLSGTNTARMIKYHYPTKAGYCGGVLYKVGSILG

SEQ ID NO: 1732 - protein, 56 aa, Rhinovirus A
IYKLFCTLQGPYSGEPKPKTKMPERRVVAQGPEEEFGRSILKNNTCVITTDNGKFT

SEQ ID NO: 1733 - protein, 56 aa, Rhinovirus A
CGKAVSFKDRSTCSTYTLAQVYNHILEEDKRRRQVVDVMSAIFQGPISLDAPPPPA

SEQ ID NO: 1734 - protein, 56 aa, Rhinovirus A
KYGLTITPADKSTEFKKLDYNNVTFLKRGFKQDEKHTFLIHPTFPVEEIYESIRWT

SEQ ID NO: 1735 - protein, 56 aa, Rhinovirus A
VKDVLEKGIPTLQSPTVEACGYSDRIIQITRGDSTITSQDVANAVVAYGVWPHYLS

SEQ ID NO: 1736 - protein, 56 aa, Rhinovirus A
VPITVSISPMFSEFSGARARPAAATQGLPVYMTPGSGQFLTTDDLQSPSALPWYHP

SEQ ID NO: 1737 - protein, 56 aa, Rhinovirus A
ITRGDSTITSQDVANAVVGYGVWPHYLTADDASAIDKPTQPDTSSNRFYTLESKVW

SEQ ID NO: 1738 - protein, 56 aa, Rhinovirus A
IDLRHFHCAEEQGVTDYIHMLGEAFGNGFVDSVKEHIHAINPVGNISKKIIKWMLR

SEQ ID NO: 1739 - protein, 56 aa, Rhinovirus A
GYNEKGTHYGTVSTNNMGTLCSRVVTEKHIHDMRIMTRVYHKAKHVKAWCPRPPRA

SEQ ID NO: 1740 - protein, 56 aa, Rhinovirus A
RKYIPESEDDYPECNLALVANQTEPTIIKVGDVVSYGNILLSGTQTARMLKYNYPT

SEQ ID NO: 1741 - protein, 56 aa, Rhinovirus A
VKDVLEKGIPTLQSPTVEACGYSDRIMQITRGDSTITSQDVANAVVGYGVWPHYLS

SEQ ID NO: 1742 - protein, 56 aa, Rhinovirus A
LQGPYSGEPKPKTKIPERRVVTQGPEEEFGMSLIKHNSCVITTENGKFTGLGVYDR

SEQ ID NO: 1743 - protein, 42 aa, Rhinovirus A
GVKYGLTITPADKSTTFRKLDYNNVTFLKRGFKQDEKYSFLI

SEQ ID NO: 1744 - protein, 56 aa, Rhinovirus A
APERRVVTQGPEEEFGRSLLKHNCCVVTTDKGKFTGLGIYDQVMVLPTHSDPGSEI

SEQ ID NO: 1745 - protein, 56 aa, Rhinovirus A
EHIQVAVAHYSAQLATLDIDPQPIAMEDSVFGMDGLEALDLNTSAGYPYVTLGIKK

SEQ ID NO: 1746 - protein, 56 aa, Rhinovirus A
VDLPMVTFLKDELRKQEKIIKGKTRVIEASSVNDTLLFRTTFGNLFSKFHLNPGIV

SEQ ID NO: 1747 - protein, 56 aa, Rhinovirus A
VIYKLFCTLQGPYSGEPKPKTKMPERRVVAQGPEEEFGRSLIKHNSCIVTTQNGKF

SEQ ID NO: 1748 - protein, 56 aa, Rhinovirus A
IASAHYAAQLITLDIDPNPITLEDSVFGTDGLEALDLNTSAGFPYITMGIKKRDLI

SEQ ID NO: 1749 - protein, 56 aa, Rhinovirus A
DGEPTLFIKPRENLTTAGPSDMYVHVGNLIYRNLHLFNSEMHDSILVSYSSDLVIY

SEQ ID NO: 1750 - protein, 56 aa, Rhinovirus A
HIHDMRIMTRVYHKAKHVKAWCPRPPRALEYTRAHRTNFKIEGENVKSRVAHRPAV

SEQ ID NO: 1751 - protein, 30 aa, Human herpesvirus 1; identical to SEQ ID NO: 5

SEQ ID NO: 1752 - protein, 30 aa, Human herpesvirus 1
HRRTRKAPKRIRLPHIREDDQPSSHQPLFY

SEQ ID NO: 1753 - protein, 53 aa, Human herpesvirus 1
PIYDEVADDQTDVLYAKIQHPRHLPDDDPIYDTVGGYDPEPAEDPVYSTVRRW

SEQ ID NO: 1754 - protein, 56 aa, Human herpesvirus 1
TPPMPSIGLEEEEEEEGAGDGEHLEGGDGTRDTLPQSPGPAFPLAEDVEKDKPNRP

SEQ ID NO: 1755 - protein, 30 aa, Human herpesvirus 1
RRRTQKGPKRIRLPHIREDDQPSSHQPLFY

SEQ ID NO: 1756 - protein, 56 aa, Human herpesvirus 1
TPPMPSIGLEEEEEEEEGAGDGEHLKGGDGTRDTLPQSPGPAVPLAGDDEKDKPNR

SEQ ID NO: 1757 - protein, 29 aa, Human herpesvirus 1
RRTRKAPKRIRLPHIREDDQPSSHQPLFY

SEQ ID NO: 1758 - protein, 56 aa, Human herpesvirus 1
PALGAAPTGDPKPKKNKKPKNPTPPRPAGDNATVAAGHATLREHLRDIKAENTDAN

SEQ ID NO: 1759 - protein, 56 aa, Human herpesvirus 1
DSPTAISLTTPDHTPPMPSIGLEEEEEEEGAGDGEHLEGGDGTRDTLPQSPGPAFP

SEQ ID NO: 1760 - protein, 56 aa, Human herpesvirus 1
PPLGAAPTGDPKPKKNKKPKNPTPPRPAGDNATVAAGHATLREHLRDIKAENTDAN

SEQ ID NO: 1761 - protein, 56 aa, Human herpesvirus 1
TPPMPSIGLEEEEEEEEEGAGDCEHLKGGDGTRDTLPQSPGPAVPLAGDDEKDKPN

SEQ ID NO: 1762 - protein, 56 aa, Human herpesvirus 1
SAAPSSPGTPGVAAATQAANGGPATPAPPALGAAPTGDPKPKKNKKPKNPTPPRPA

SEQ ID NO: 1763 - protein, 56 aa, Human herpesvirus 1
TTRQPVATPTTSARPRGHLTVSRLSAPQPQPQPQPQPQPQPQPQPQPQPQPQPQPQ

SEQ ID NO: 1764 - protein, 56 aa, Human herpesvirus 1
PQPQPQPQPQPQPQPQPQPQPQPQPQPQPQPQPQPQPQPQNGHVAPGEYPAVRFRA

SEQ ID NO: 1765 - protein, 56 aa, Human herpesvirus 1
SAAPSSPGTPGVAAATQAANGGPATPAPPAPGAPPTGDPKPKKNRKPKPPKPPRPA

SEQ ID NO: 1766 - protein, 56 aa, Human herpesvirus 1
PAPGAPPTGDPKPKKNRKPKPPKPPRPAGDNATVAAGHATLREHLRDIKAENTDAN

SEQ ID NO: 1767 - protein, 56 aa, Human herpesvirus 1
PQPQPQPQPQPQPQPQPQPQPQPQPQPQPQPQPQPQPQPQPQPQPQPQPQPQPQPQ

SEQ ID NO: 1768 - protein, 56 aa, Human herpesvirus 1
SAAPTSPGTPGVAAATQAANGGPATPAPPPLGAAPTGDPKPKKNKKPKNPTPPRPA

SEQ ID NO: 1769 - protein, 56 aa, Human herpesvirus 1
LAEDVEKDKPNRPVVPSPDPNNSPARPETSRPKTPPTIIGPLATRPTTRLTSKGRP

SEQ ID NO: 1770 - protein, 47 aa, Human herpesvirus 1
PPAATGSQPEASNAEAGALVNASSAAHVDVDTARAADLFVSQMMGAR

SEQ ID NO: 1771 - protein, 56 aa, Human herpesvirus 1
MSQTQPPAPVGPGDPDVYLKGVPSAGMHPRGVHAPRGHPRMISGPPQRGDNDQAAG

SEQ ID NO: 1772 - protein, 56 aa, Human herpesvirus 1
GTRDTLPQSPGPAFPLAEDVEKDKPNRPVVPSPDPNNSPARPETSRPKTPPTIIGP

SEQ ID NO: 1773 - protein, 56 aa, Human herpesvirus 1
LVAGHAAPQPQPHSAFGFPAAAGSVAYGPHGAGLSQHYPPHVAHQYPGVLFSGPSP

SEQ ID NO: 1774 - protein, 56 aa, Human herpesvirus 1
LIAYQPLLSNTLAELYVREHLREQSRKPPNPTPPPPGASANASVERIKTTSSIEFA

SEQ ID NO: 1775 - protein, 56 aa, Human herpesvirus 1
SEDGGRVYEEIPWMRVYENVCVNTANAAPASPYIEAENPLYDWGGSALFSPPGRTG

SEQ ID NO: 1776 - protein, 56 aa, Human herpesvirus 1
PAACPPGPPPPPCPSTQTRAPLPTEPAFPPAATGSQPEASNAEAGALVNASSAAHV

SEQ ID NO: 1777 - protein, 56 aa, Human herpesvirus 1
PHGAGLSQHYPPHVAHQYPGVLFSGPSPLEAQIAALVGAIAADRQAGGQPAAGDPG

SEQ ID NO: 1778 - protein, 56 aa, Human herpesvirus 1
RTPTTAPRAPRTQRVATKAPAAPAAETTRGRKSAQPESAALPDAPASTAPTRSKTP

SEQ ID NO: 1779 - protein, 56 aa, Human herpesvirus 1
LPETPNATQPELAPEDPEDSALLEDPVGTVAPQIPPNWHIPSIQDAATPYHPPATP

SEQ ID NO: 1780 - protein, 56 aa, Human herpesvirus 1
ARRKATHAASARERHAPYEDDESIYETVSEDGGRVYEEIPWMRVYENVCVNTANAA

SEQ ID NO: 1781 - protein, 56 aa, Human herpesvirus 1; identical to SEQ ID NO: 1771

SEQ ID NO: 1782 - protein, 56 aa, Human herpesvirus 1
PWFLDGLGMDRMYWRDTNTGRLWLPNTPDPQKPPRGFLAPPDELNLTTASLPLLRW

SEQ ID NO: 1783 - protein, 56 aa, Human herpesvirus 1
QCGDSGLLRVGADTTISKPSEAVRPPTIPRTPRVPREPRVPRPPREPREPRVPRAP

SEQ ID NO: 1784 - protein, 56 aa, Human herpesvirus 1
TTKELKNPTNPDASGEGEEGGDFDEAKLAEAREMIRYMALVSAMERTEHKAKKKGT

SEQ ID NO: 1785 - protein, 56 aa, Human herpesvirus 1
PRGVHAPRGHPRMISGPPQRGDNDQAAGQCGDSGLLRVGADTTISKPSEAVRPPTF

SEQ ID NO: 1786 - protein, 28 aa, Human herpesvirus 1
PIIATSDPTPRRDAATKSRRRRPHSRRL

SEQ ID NO: 1787 - protein, 56 aa, Human herpesvirus 1
TPEPRGSLAVRLEDEFGEFDWTPQEGSQPWLSAVVADTSSVERPGPSDSGAGRAAE

SEQ ID NO: 1788 - protein, 56 aa, Human herpesvirus 1
PVPTSGTPAPAPPGDGSYLWIPASHYNQLVAGHAAPQPQPHSAFGFPAAAGSVAYG

SEQ ID NO: 1789 - protein, 56 aa, Human herpesvirus 1
MTSRLSDPNSSARSDMSVPLYPTASPVSVEAYYSESEDEAANDFLVRMGRQQSVLR

SEQ ID NO: 1790 - protein, 56 aa, Human herpesvirus 1
VSSTTQPQLQTTGRPSHEAPNMTQTGTTDSPTAISLTTPDHTPPMPSIGLEEEEEE

SEQ ID NO: 1791 - protein, 56 aa, Human herpesvirus 1
AEAREMIRYMALVSAMERTEHKAKKKGTSALLSAKVTDMVMRKRRNTNYTQVPNKD

SEQ ID NO: 1792 - protein, 56 aa, Human herpesvirus 1
QCGDSGLLRVGADTTISKPSEAVRPPTIPRTPRVPREPRVPRPPREPREPRVPRAS

SEQ ID NO: 1793 - protein, 56 aa, Human herpesvirus 1
PIYSPQMPTGISCAVNEAAMARLGAELKSHPSTPPKSRRRSSRTPMPSLTAIAEES

SEQ ID NO: 1794 - protein, 56 aa, Human herpesvirus 1
PRGVHAPRGHPRMISGPPQRGDNDQAAGQCGDSGLLRVGADTTISKPSEAVRPPTI

SEQ ID NO: 1795 - protein, 56 aa, Human herpesvirus 1
CAVNEAAMARLGAELKSHPSTPPKSRRRSSRTPMPSLTAIAEESEPAGAAGLPTPP

SEQ ID NO: 1796 - protein, 56 aa, Human herpesvirus 1
PASPYIEAENPLYDWGGSALFSPPGRTGPPPPPLSPSPVLARHRANALTNDGPTNV

SEQ ID NO: 1797 - protein, 54 aa, Human herpesvirus 1
SHPSTPPKSRRRSSRTPMPSLTAIAEESEPAGAAGLPTPPVDPTTPTPTPPLLV

SEQ ID NO: 1798 - protein, 56 aa, Human herpesvirus 1
EGAGDGEHLEGGDGTRDTLPQSPGPAFPLAEDVEKDKPNRPVVPSPDPNNSPARPE

SEQ ID NO: 1799 - protein, 56 aa, Human herpesvirus 1
DGTRDTLPQSPGPAVPLAGDDEKDKPNRPVVPPPGPNNSPARPETSRPKHPPPVSG

SEQ ID NO: 1800 - protein, 56 aa, Human herpesvirus 1
AVDFIWTGNQRFAPRYLTLGGHTVRALSPTHPEPTTDEDDDDLDDADYVPPAPRRT

SEQ ID NO: 1801 - protein, 39 aa, Human herpesvirus 1
GLEEEEEGAGDGEHLEGGDGTRDTLPQSPGPAVTLAGDD

SEQ ID NO: 1802 - protein, 38 aa, Human herpesvirus 1
VVPSPDPNNSPARPETSRPKTPPTIIGPLATRPTTRLT

SEQ ID NO: 1803 - protein, 56 aa, Human herpesvirus 1
RFFLDMSAESTTGTETDASVSDDPDDTSDWSYDDIPPRPKRARVNLRLTSSPDRRD

SEQ ID NO: 1804 - protein, 38 aa, Human herpesvirus 1
EVLGAEAGLATPPRREVVDWEGAWDEDDGGAFEGDGVL

SEQ ID NO: 1805 - protein, 56 aa, Human herpesvirus 1
RLGAELKSHPSTPPKSRRRSSRTPMPSLTAIAEESEPAGAAGLPTPPVDPTTSTPT

SEQ ID NO: 1806 - protein, 56 aa, Human herpesvirus 1
NMVVPEIAPGEECPSDPVTDPAHPLHPANLVANTVNAMFHNGRVVVDGPAMLTLQV

SEQ ID NO: 1807 - protein, 56 aa, Human herpesvirus 1
TAHDFDVVDIESEEEGNFYVPPDMRGVTRAPGRQRLRSSDPPSRHTHRRTPGGACP

SEQ ID NO: 1808 - protein, 56 aa, Human herpesvirus 1
PQPQPQPQPQPQNGHVAPGEYPAVRFRAPQNRPSVPASASSTNPRTGSSLSGVSSW

SEQ ID NO: 1809 - protein, 56 aa, Human herpesvirus 1
IRSMAESDVVMEDVAIAERALGLSAFGVAGGTRSGGIGVTEAPSLGHPHTPPPEVT

SEQ ID NO: 1810 - protein, 56 aa, Human herpesvirus 1
GDGTRDTLPQSPGPAVPLAGDDEKDKPNRPVVPPPGPNNSPARPETSRPKTPPTSI

SEQ ID NO: 1811 - protein, 56 aa, Human herpesvirus 1
PRTPRVPREPRVPRPPREPREPRVPRAPRDPRVPRDPRDPRQPRSPREPRSPREPR

SEQ ID NO: 1812 - protein, 56 aa, Human herpesvirus 1
IEDDPSADAADDVDEDAPDDVAYPEEYAEELFLPGDATGPLIGANDHIPPPCGASP

SEQ ID NO: 1813 - protein, 56 aa, Human herpesvirus 1
PRTPRVPREPRVPRPPREPREPRVPRAPRDPRVPRDPRDPRQPREPRPPRDPRQPR

SEQ ID NO: 1814 - protein, 56 aa, Human herpesvirus 1
QRTVAVYSLKIAGWHGPKAPYTSTLLPPELSETPNATQPELAPEDPEDSALLEDPV

SEQ ID NO: 1815 - protein, 56 aa, Human herpesvirus 1
MTSRRSVKSGPREVPRDEYEDLYYTPSSGMASPDSPPDTSRRGALQTRSRQRGEVR

SEQ ID NO: 1816 - protein, 56 aa, Human herpesvirus 1
QPLDPEGPIAVTPRPPIRPSSGKAPHPEAPRRSPNWATAGEVDVGDELIAISDERG

SEQ ID NO: 1817 - protein, 56 aa, Human herpesvirus 1
PRVWGPAPEGEPDQMEATYLTADDDDDDARRKATHAASARERHAPYEDDESIYETV

SEQ ID NO: 1818 - protein, 56 aa, Human herpesvirus 1
SASRASGSEPTDSQDSASDAVSHGDPEDLDGAARAGEAGALHACPMPSSTTRVTPT

SEQ ID NO: 1819 - protein, 49 aa, Human herpesvirus 1
QRANELVNPDVVQDVDAATATRGRSAASRPTERPRAPARSASRPRRPVE

SEQ ID NO: 1820 - protein, 56 aa, Human herpesvirus 1
ELSETPNATQPELAPEDPEDSALLEDPVGTVAPQIPPNWHIPSIQDAATPYHPPAT

SEQ ID NO: 1821 - protein, 56 aa, Human herpesvirus 1
TASDSTESGDQDEAPRIGGRRAPRRLGGRFFLDMSAESTTGTETDASVSDDPDDTS

SEQ ID NO: 1822 - protein, 56 aa, Human herpesvirus 1
IAAAPQGDRCPIVRQRGVALSPVLPPMNPVPTSGTPAPAPPGDGSYLWIPASHYNQ

SEQ ID NO: 1823 - protein, 56 aa, Human herpesvirus 1
PRTPRVPREPRVPRPPREPREPRVPRASRDPRVPRDPRDPRQPRSPREPRSPREPR

SEQ ID NO: 1824 - protein, 56 aa, Human herpesvirus 1
MGLSFSGARPCCCRNNVLITDDGEVVSLTAHDFDVVDIESEEEGNFYVPPDMRGVT

SEQ ID NO: 1825 - protein, 56 aa, Human herpesvirus 1
GMASPDSPPDTSRRGALQTRSRQRGEVRFVQYDESDYALYGGSSSEDDEHPEVPRT

SEQ ID NO: 1826 - protein, 56 aa, Human herpesvirus 1
RGRKSAQPESAALPDAPASTAPTRSKTPAQGLARKLHFSTAPPNPDAPWTPRVAGF

SEQ ID NO: 1827 - protein, 56 aa, Human herpesvirus 1
MGLSFSGARPCCCRNNVLITDDGEVVSLTAHDFDVVDIESEEEGNFYVPPDMRVVT

SEQ ID NO: 1828 - protein, 56 aa, Human herpesvirus 1
LEAQIAALVGAIAADRQAGGQPAAGDPGVRGSGKRRRYEAGPSESYCDQDEPDADY

SEQ ID NO: 1829 - protein, 56 aa, Human herpesvirus 1
EAGRPRGRTGPLVNRPAPLANNRDPIVISDSPPASPHRPPAAPMPGSAPRPGPPAS

SEQ ID NO: 1830 - protein, 36 aa, Human herpesvirus 1
SALLSAKVTDMVMRKRRNTNYTQVPNKDGDADEDDL

SEQ ID NO: 1831 - protein, 56 aa, Human herpesvirus 1
TPRPTERQGPNDPQPAPHSVWSRLGARRPSCSPEQHGGKVARLQPPPTKAQPARGG

SEQ ID NO: 1832 - protein, 56 aa, Human herpesvirus 1
FVQYDESDYALYGGSSSEDDEHPEVPRTRRPVSGAVLSGPGPARAPPPPAGSGGAG

SEQ ID NO: 1833 - protein, 56 aa, Human herpesvirus 1
STTTSTPSTTIPAPQASTTPFPTGDPKPQPHGVNHEPPSNATRATRDSRYALTVTQ

SEQ ID NO: 1834 - protein, 40 aa, Human herpesvirus 1
RPVVPPPGPNNSPARPETSRPKTPPTSIGPLATRPTTQLP

SEQ ID NO: 1835 - protein, 56 aa, Human herpesvirus 1
GDELHLDGEDVAMAHADALDDFDLDMLGDGDSPGPGFTPHDSAPYGALDMADFEFE

SEQ ID NO: 1836 - protein, 56 aa, Human herpesvirus 1
TAHDFDVVDIESEEEGNFYVPPDMRVVTRAPGRQRLRSSDPPSRHTHRRTPGGACP

SEQ ID NO: 1837 - protein, 56 aa, Human herpesvirus 1
SDSPPASPHRPPAAPMPGSAPRPGPPASAAASGPARPRAAVAPCVRAPPPGPGPRA

SEQ ID NO: 1838 - protein, 56 aa, Human herpesvirus 1
MASENKQRPGSPGPTDGPPPTPSPDRDERGALGWGAETEEGGDDPDHDPDHPHDLD

SEQ ID NO: 1839 - protein, 56 aa, Human herpesvirus 1
ALLASMVEEAVRTIPTPDPAASPPRTPAFRADDDDGDEYDDAADAAGDRAPARGRE

SEQ ID NO: 1840 - protein, 56 aa, Human herpesvirus 1
IRHLDGEKNVTWTLFDRDTSMSLADFHGEEFEKLYQHLEVMGFGEQIPIQELAYGI

SEQ ID NO: 1841 - protein, 56 aa, Human herpesvirus 1; identical to SEQ ID NO: 1816

SEQ ID NO: 1842 - protein, 56 aa, Human herpesvirus 1
MYTPVAHYRPQVGEPEPTTTHPALCPPEAVYRPPPHSAPYGPPQGPASHAPTPPYA

SEQ ID NO: 1843 - protein, 56 aa, Human herpesvirus 1
TNGTSGRTPVLPPDDEAGLQPKPLTTPPPIIATSDPTPRRDAATKSRRRRPHSRRL

SEQ ID NO: 1844 - protein, 56 aa, Human herpesvirus 1
LADASLKMADPNRFRGKDLPVPDRLTDPPGVRRVYHIQAGLPDPFQPPSLPITVYY

SEQ ID NO: 1845 - protein, 39 aa, Human herpesvirus 1
PVVPPPGPNNSPARPETSRPKHPPPVSGRWQLDPRPNSP

SEQ ID NO: 1846 - protein, 56 aa, Human herpesvirus 1
PTHPEPTTDEDDDDLDDADYVPPAPRRTPRAPPRRGAAAPPVTGGASHAAPQPAAA

SEQ ID NO: 1847 - protein, 56 aa, Human herpesvirus 1
MDPALRSYHQRLRLYTPVATGINLAASSQPLDPEGPIAVTPRPPIRPSSGKAPHPE

SEQ ID NO: 1848 - protein, 54 aa, Human herpesvirus 1
SPSTNGSGFEILSPTAPSVYPRSDGHQSRRQLTTFGSGRPDRRYSQASDSSVFW

SEQ ID NO: 1849 - protein, 56 aa, Human herpesvirus 1
SGAGSGGAGAKRATVSEFVQVKHIDRVGPAGVSPAPPPNNTDSSSLVPGAQDSAPP

SEQ ID NO: 1850 - protein, 49 aa, Human herpesvirus 1
RDPRVPRDPRDPRQPRSPREPRSPREPRSPREPRTPRTPREPRTARGSV

SEQ ID NO: 1851 - protein, 56 aa, Human herpesvirus 1
TKRGRSGGEDARADTALKKPKTGSPTAPPPADPVPLDTEDDSDAADGTAARPAAPD

SEQ ID NO: 1852 - protein, 48 aa, Human herpesvirus 1
CEDDNATPFGGPGAPGPAFAGRKRAFHGDDPFGEGPPDKKGDLTLDML

SEQ ID NO: 1853 - protein, 42 aa, Human herpesvirus 1
DGDSPGPGFTPHDSAPYGALDMADFEFEQMFTDALGIDEYGG

SEQ ID NO: 1854 - protein, 56 aa, Human herpesvirus 1
LADASLKMADPNRFRGKDLPVLDQLTDPPGVRRVYHIQAGLPDPFQPPSLPITVYY

SEQ ID NO: 1855 - protein, 56 aa, Human herpesvirus 1
VRGSGKRRRYEAGPSESYCDQDEPDADYPYYPGEARGAPRGVDSRRAARHSPGTNE

SEQ ID NO: 1856 - protein, 56 aa, Human herpesvirus 1
TDLEAAGSDHTLASQSDTEDAPSPVTLETPEPRGSLAVRLEDEFGEFDWTPQEGSQ

SEQ ID NO: 1857 - protein, 56 aa, Human herpesvirus 1
TSRPKTPPTIIGPLATRPTTRLTSKGRPLVPTPQHTPLFSFLTASPALDTLFVVST

SEQ ID NO: 1858 - protein, 56 aa, Human herpesvirus 1
MEPRPGASTRRPEGRPQREPAPDVWVFPCDRDLPDSSDSEAETEVGGRGDADHHDD

SEQ ID NO: 1859 - protein, 22 aa, Human herpesvirus 1
MATDIDMLIDLGLDLSDSDLDE

SEQ ID NO: 1860 - protein, 56 aa, Human herpesvirus 1
RTVAVYSLKIAGWHGPRAPYTSTLLPPELPETPNATQPELAPEDPEDSALLEDPVG

SEQ ID NO: 1861 - protein, 56 aa, Human herpesvirus 1
TVAPQIPPNWHIPSIQDAATPYHPPATPNNMGLIAGAVGGSLLAALVICGIVYWMR

SEQ ID NO: 1862 - protein, 56 aa, Human herpesvirus 1
SEQPDPPGGQRTRGVRQAPPPLMTLAIAPPPADPRAPAPERKAPAADTIDATTRLV

SEQ ID NO: 1863 - protein, 56 aa, Human herpesvirus 1
GTVAPQIPPNWHIPSIQDAATPYHPPATPNNMGLIAGAVGGSLLAALVICGIVYWM

SEQ ID NO: 1864 - protein, 56 aa, Human herpesvirus 1
QCGDSGLLRVGADTTISKPSEAVRPPTFPRTPRVPREPRVPRPPREPREPRVPRAP

SEQ ID NO: 1865 - protein, 56 aa, Human herpesvirus 1
EHLARLRLRRAGGEGAPEPPATPATPATPATPATPATPATPATPATPATPARVRFS

SEQ ID NO: 1866 - protein, 56 aa, Human herpesvirus 1
LADQEEQLEEAATNASLWGDGDLAEGWMSPADSDLLVMWQLTSAPKVHANGPSRIG

SEQ ID NO: 1867 - protein, 56 aa, Human herpesvirus 1
ALPPAPPGIRWASATGRSGTVLAAAGAVEVLGAEAGLATPPRREVVDWEGAWDEDD

SEQ ID NO: 1868 - protein, 56 aa, Human herpesvirus 1
LADASLKMADPNRFRGKDLPVLDQLTDPPGVRRVYHIQAGLPNPFQPPSLPITVYR

SEQ ID NO: 1869 - protein, 56 aa, Human herpesvirus 1
APRRSPNWATAGEVDVGDELIAISDERGPPRHDRPPLATSTAPSPHPRPPGYTAVV

SEQ ID NO: 1870 - protein, 56 aa, Human herpesvirus 1
HPGLATVRSTLPISYDYSEYICRLTGYPAGIPVLEHHGSHQPPPRDPTERQVIEAI

SEQ ID NO: 1871 - protein, 56 aa, Human herpesvirus 1
NQEQSLCRARATVARGSGGPGVEGGHGPSRGAAPSGAAPLPSAASVEQEAAVRPRK

SEQ ID NO: 1872 - protein, 56 aa, Human herpesvirus 1
MATDIDMLIDLGLDLSDSDLDEDPPEPAESRRDDLESDSSGECSSSDEDMEDPHGE

SEQ ID NO: 1873 - protein, 56 aa, Human herpesvirus 1
DKTPGSASYRISDNNFVQCGSNCTMIIDGDVVRGRPQDPGAAASPAPFVAVTNIGA

SEQ ID NO: 1874 - protein, 56 aa, Human herpesvirus 1
LDGAARAGEAGALHACPMPSSTTRVTPTTKRGRSGGEDARADTALKKPKTGSPTAP

SEQ ID NO: 1875 - protein, 56 aa, Human herpesvirus 1
MEPRPGASTRRPEGRPQREPAPDVWVFPCDRDLSDSIYSEADTEVGGRGDLRPPLT

SEQ ID NO: 1876 - protein, 56 aa, Human herpesvirus 1
NSLPAPMPMDAQKPEAYGHGPRQADREGAPHSNTPVEDDEMIPEDTVAPPTDLPLT

SEQ ID NO: 1877 - protein, 56 aa, Human herpesvirus 1
DPSLKMADPNRFRGKDLPVLDQLTDPPGVRRVYHIQAGLPDPFQPPSLPITVYYAV

SEQ ID NO: 1878 - protein, 56 aa, Human herpesvirus 1
PAFAPASPGEDTAGGTPPPQTCGIVKRLLRLAATEQQGPTPPAIAALIRNAAVQTP

SEQ ID NO: 1879 - protein, 56 aa, Human herpesvirus 1
PAPGAEPAARPADARRVPQSHSSLAQAANQEQSLCRARATVARGSGGPGVEGGHGP

SEQ ID NO: 1880 - protein, 56 aa, Human herpesvirus 1
GDVVRGRPQDPGAAASPAPFVAVTNIGAGSDGGTAVVAFGGTPRRSAGTSTGTQTA

SEQ ID NO: 1881 - protein, 56 aa, Human herpesvirus 1
SRGAAPSGAAPLPSAASVEQEAAVRPRKRRGSGQENPSPQSTRPPLAPAGAKRAAT

SEQ ID NO: 1882 - protein, 56 aa, Human herpesvirus 1; identical to SEQ ID NO: 1869

SEQ ID NO: 1883 - protein, 56 aa, Human herpesvirus 1
AGGTRSGGIGVTEAPSLGHPHTPPPEVTLAPAARNGDALPDPKPESCPRVSVPRPT

SEQ ID NO: 1884 - protein, 56 aa, Human herpesvirus 1
APRQPLDAHNPRTDVVITGRRAPRPIAGSGAGSGGAGAKRATVSEFVQVKHIDRVG

SEQ ID NO: 1885 - protein, 46 aa, Human herpesvirus 1
PPPPPLSPSPVLARHRANALTNDGPTNVAALSALLTKLKREGRRSR

SEQ ID NO: 1886 - protein, 56 aa, Human herpesvirus 1
MDPALRSYHQRLRLYTPVAMGINLAASSQPLDPEGPIAVTPRPPIRPSSGKAPHPE

SEQ ID NO: 1887 - protein, 32 aa, Human herpesvirus 1
SQRLNGGKGGEKQTTRTWGVFGGLLAPGAKGW

SEQ ID NO: 1888 - protein, 56 aa, Human herpesvirus 1
NHELTLWNEARKLNPNAIASATVGRRVSARMLGDVMAVSTCVPVAADNVIVQNSMR

SEQ ID NO: 1889 - protein, 56 aa, Human herpesvirus 1
PGIPEYAEDPYAISYGGQLDRYGDSDGEPIYDEVADDQTDVLYAKIQHPRHLPDDD

SEQ ID NO: 1890 - protein, 56 aa, Human herpesvirus 1
DWSYDDIPPRPKRARVNLRLTSSPDRRDGVIFPKMGRVRSTRETQPRAPTPSAPSP

SEQ ID NO: 1891 - protein, 56 aa, Human herpesvirus 1
PNPTPPPPGASANASVERIKTTSSIEFARLQFTYNHIQRHVNDMLGRVAIAWCELQ

SEQ ID NO: 1892 - protein, 56 aa, Human herpesvirus 1
SPEVTPTSTPNPNNVTQNKTTPTEPAGPPTTPKPTSTPKSPPHVHPRPQTQEQHHP

SEQ ID NO: 1893 - protein, 46 aa, Human herpesvirus 1
RDPRVPRDPRDPRQPREPRPPRDPRQPREPRTPRTPREPRTARGSV

SEQ ID NO: 1894 - protein, 56 aa, Human herpesvirus 1
RKSPGPARPPGGGGPRPPKTKKSGADAPGSDARAPLPAPAPPSTPPGPEPAPAQPA

SEQ ID NO: 1895 - protein, 56 aa, Human herpesvirus 1
NPRVVPGDVALDQACFRISGAARNSSSFITGSVARAVPHLGYAMAAGRFGWGLAHA

SEQ ID NO: 1896 - protein, 56 aa, Human herpesvirus 1
PPADPVPLDTEDDSDAADGTAARPAAPDARSGSRYACYFRDLPTGEASPGAFSAFR

SEQ ID NO: 1897 - protein, 56 aa, Human herpesvirus 1
MDESRRQRPAGHVAVNLSPQGARQRSFKDWLASYIHSNPHGASGRPSGPSLQDAAV

SEQ ID NO: 1898 - protein, 56 aa, Human herpesvirus 1
SSSDEDEDDDGNDAADHAREARAVGRGPSSAAPAAPGRTPPPPGPPPLSEAAPKPR

SEQ ID NO: 1899 - protein, 56 aa, Human herpesvirus 1
APEARPTAAAPRPRSPPPGAGPGGGANPSHPPSRPFRLPPRLALRLRVTAEHLARL

SEQ ID NO: 1900 - protein, 56 aa, Human herpesvirus 1
DGPEPILDAARPAVRPSRPEDPGVPSTQTPRPTERQGPNDPQPAPHSVWSRLGARR

SEQ ID NO: 1901 - protein, 56 aa, Human herpesvirus 1
RRRSAVFGGEGDPVGPAEFVSDDRSSDSDSDDSEDTDSETLSHASSDVSGGATYDD

SEQ ID NO: 1902 - protein, 56 aa, Human herpesvirus 1
ESRRDDLESDSSGECSSSDEDMEDPHGEDGPEPILDAARPAVRPSRPEDPGVPSTQ

SEQ ID NO: 1903 - protein, 42 aa, Human herpesvirus 1
SSRTPMPSLTAIAEESEPAGAAGLPTPPVDPTTSTPTPPLLV

SEQ ID NO: 1904 - protein, 56 aa, Human herpesvirus 1
SPEVTPTSTPNPNNVTQNKTTPTEPASPPTTPKPTSTPKSPPTSTPDPKPKNNTTP

SEQ ID NO: 1905 - protein, 56 aa, Human herpesvirus 1
RAHSALKRVRSSMRGSRDGRHRPAPGSPPGIPEYAEDPYAISYGGQLDRYGDSDGE

SEQ ID NO: 1906 - protein, 56 aa, Human herpesvirus 1
GQGLLRRVLRPPISRRDGPVLPRGSGPRRAASTLWLLGLDGTDAPPGALTPNDDTE

SEQ ID NO: 1907 - protein, 56 aa, Human herpesvirus 1
ASVYQPAPNPASTPSTTTSTPSTTIPAPQASTTPFPTGDPKPQPHGVNHEPPSNAT

SEQ ID NO: 1908 - protein, 56 aa, Human herpesvirus 1
LARHHPGFEAPTIDGAVAAHQDKMRRLADTCMATILQMYMSVGAADKSADVLVSQA

SEQ ID NO: 1909 - protein, 48 aa, Human herpesvirus 1
LAPAARNGDALPDPKPESCPRVSVPRPTASPTAPRPGPSRAAPCVLGQ

SEQ ID NO: 1910 - protein, 56 aa, Human herpesvirus 1
ESTRPAPVGPRDDFRRLPSPQSSPAPPDATAPRPPASSRASAASSSGSRARRHRRA

SEQ ID NO: 1911 - protein, 56 aa, Human herpesvirus 1
RSREAYGAEAGLGVAGTGFRARGDGFGPLPLLTQGPSRPWHQALRGLKHLRIGPPA

SEQ ID NO: 1912 - protein, 56 aa, Human herpesvirus 1
ASTGPTITAGAVTNASEAPTSGSPGSAASPEVTPTSTPNPNNVTQNKTTPTEPASP

SEQ ID NO: 1913 - protein, 56 aa, Human herpesvirus 1
AVYRPPPHSAPYGPPQGPASHAPTPPYAPAACPPGPPPPPCPSTQTRAPLPTEPAF

SEQ ID NO: 1914 - protein, 56 aa, Human herpesvirus 1
GLAAPRLSFLPAGHTRRLSTAPPTDVSLGDELHLDGEDVAMAHADALDDFDLDMLG

SEQ ID NO: 1915 - protein, 56 aa, Human herpesvirus 1
IGVPPVGTLDEDVAADVVTAPSRARGGAGDGGGSGGRGGPRNPPPDPCGEGLLDTG

SEQ ID NO: 1916 - protein, 56 aa, Human herpesvirus 1
TPPSRSQTRRAIRREHTSSRSTETRPPLPPAAGGTEMRVSWTEILTQQIAGGYEDD

SEQ ID NO: 1917 - protein, 56 aa, Human herpesvirus 1
RPRTDEDLNELLGITTIRVTVCEGKNLLQRANELVNPDVVQDVDAATATRGRSAAS

SEQ ID NO: 1918 - protein, 56 aa, Human herpesvirus 1
ASVYQPAPNQASTPSTTTSTPSTTIPAPSTTIPAPQASTTPFPTGDPKPQPPGVNH

SEQ ID NO: 1919 - protein, 56 aa, Human herpesvirus 1
SRQSRAAAPRGASGPSGGVGVGVGVVEAEAGRPRGRTGPLVNRPAPLANNRDPIVI

SEQ ID NO: 1920 - protein, 56 aa, Human herpesvirus 1
ASSVFVATVKSLGPRTQQLQIEDWLALLEDEYLSEEMMELTARALERGNGEWSTDA

SEQ ID NO: 1921 - protein, 56 aa, Human herpesvirus 1
NVAGPDRRPPAATCPLLVRRASLGSLDRPRVWGPAPEGEPDQMEATYLTADDDDDD

SEQ ID NO: 1922 - protein, 56 aa, Human herpesvirus 1
MPFVGGAESGDPLGAGRPIGDDECEQYTSSVSLARMLYGGDLAEWVPRVHPKTTIE

SEQ ID NO: 1923 - protein, 56 aa, Human herpesvirus 1
RYRRSRRPIYSPQIPTGISCAVNEAAMARLGAELKSHPSTPPKSRRRSSRTPMPSL

SEQ ID NO: 1924 - protein, 56 aa, Human herpesvirus 1
RQQHGPVTFPNASAPTARCVTVVRAPMGSGKTTALIRWLREAIHSPDTSVLVVSCR

SEQ ID NO: 1925 - protein, 56 aa, Human herpesvirus 1
DARRDGRAPAAGTDAGEDAGDAVSPRQLALLASMVEEAVRTIPTPDPAASPPRTPA

SEQ ID NO: 1926 - protein, 56 aa, Human herpesvirus 1
LVDASLKMADPNRFRGKDLPVLDQLTDPPGVRRVYHIQAGLPDPFQPPSLPITVYY

SEQ ID NO: 1927 - protein, 56 aa, Human herpesvirus 1
PSGSFSTIPIVNDPQTRMEAEEAVRAGTAVDFIWTGNQRFAPRYLTLGGHTVRALS

SEQ ID NO: 1928 - protein, 56 aa, Human herpesvirus 1
HTTPPSEAERLCHLQEILAQMYGNQDYPIEDDPSADAADDVDEDAPDDVAYPEEYA

SEQ ID NO: 1929 - protein, 54 aa, Human herpesvirus 1
LTAPPRPPRTSSPSRASASYAAPCSPSTPPYTTRPSRSPGPEASGGLGDTVTSN

SEQ ID NO: 1930 - protein, 56 aa, Human herpesvirus 1
GSDARAPLPAPAPPSTPPGPEPAPAQPAAPRAAAAQARPRPVAVSRRPAEGPDPLG

SEQ ID NO: 1931 - protein, 56 aa, Human herpesvirus 1
MDRDAAHAALRRRLAETHLRAEIYKDQTLQLHREGVSTQDPRFVGAFMAAKAAHLE

SEQ ID NO: 1932 - protein, 56 aa, Human herpesvirus 1
FRADDDDGDEYDDAADAAGDRAPARGREREAPLRGAYPDPTDRLSPRPPAQPPRRR

SEQ ID NO: 1933 - protein, 56 aa, Human herpesvirus 1
RGALGWGAETEEGGDDPDHDPDHPHDLDDARRDGRAPAAGTDAGEDAGDAVSPRQL

SEQ ID NO: 1934 - protein, 56 aa, Human herpesvirus 1
ERDRELRRATAGALERQQRAADLAAESVTGGCGSRPAGADLLRADYDIIDVSKSMD

SEQ ID NO: 1935 - protein, 56 aa, Human herpesvirus 1
HSTPASTRRFRRRRADGAGPPLPDANDPVAEPPAAATQPATYYTHMGEVPPRLPAR

SEQ ID NO: 1936 - protein, 56 aa, Human herpesvirus 1
PPRRAPSPGCLRSWPIPAPWNARAHPILGRVAPQKTASVWTAAGKCASPPPAPIRV

SEQ ID NO: 1937 - protein, 56 aa, Human herpesvirus 1
TPPSRSQTRRAIRREHTSSRSTETRPPLPPAAGGTETRVSWTEILTQQIAGGYEDD

SEQ ID NO: 1938 - protein, 56 aa, Human herpesvirus 1
TQGEAAGAPLAHGHHVYCQRVNGVMVLSDKTPGSASYRISDNNFVQCGSNCTMIID

SEQ ID NO: 1939 - protein, 56 aa, Human herpesvirus 1
GPQAAGQASPALPIDPVPPPVATGTVLPGGENRRPPLTSGPAPTPPRVPVGGPQRR

SEQ ID NO: 1940 - protein, 56 aa, Human herpesvirus 1
MASYPCHQHASAFDQAARSRGHSNRRTALRPRRQQEATEVRLEQKMPTLLRVYIDG

SEQ ID NO: 1941 - protein, 56 aa, Human herpesvirus 1
QRIVAVYSLKIAGWHGPKAPYTSTLLPPELSETPNATQPELAPEDPEDSALLEDPV

SEQ ID NO: 1942 - protein, 56 aa, Human herpesvirus 1
VNCMEPVVFGAKAILARTTAQCRTDEEASDVDASPPPSPITDSRPSSAFSNMRRRG

SEQ ID NO: 1943 - protein, 56 aa, Human herpesvirus 1
MADISPGAFAPCVKARRPALRSPPLGTRKRKRPSRPLSSESEVESDTALESEVESE

SEQ ID NO: 1944 - protein, 51 aa, Human herpesvirus 1
SHPTYTPTPTGPPGAPAAPLSRTPPSPAPPTGPATDPASASGFARDYPDGE

SEQ ID NO: 1945 - protein, 56 aa, Human herpesvirus 1
EEFEKLYQHLEVMGFGEQIPIQELAYGIVRSAATTGSPFVMFKDAVNRHYIYDTQG

SEQ ID NO: 1946 - protein, 56 aa, Human herpesvirus 1
MSRKNRPPSLRGALRPPMRGASSWSPDSVESDAVSDSTSDSKAVSVSTSDSDERGR

SEQ ID NO: 1947 - protein, 56 aa, Human herpesvirus 1
ARMLGDVMAVSTCVPVAADNVIVQNSMRISSRPGACYSRPLVSFRYEDQGPLVEGQ

SEQ ID NO: 1948 - protein, 56 aa, Human herpesvirus 1
SHTPVKAGCVNFDYSRTRRCVGRQDLGPTNGTSGRTPVLPPDDEAGLQPKPLTTPP

SEQ ID NO: 1949 - protein, 56 aa, Human herpesvirus 1
LDVCPGTPGPGADAGGPSAVDPHAPTPEAGAGLAADPAVARDDAEGLSDPRPRLGT

SEQ ID NO: 1950 - protein, 56 aa, Human herpesvirus 1
DSDDSEDTDSETLSHASSDVSGGATYDDALDSDSSSDDSLQIDGPVCRPWSNDTAP

SEQ ID NO: 1951 - protein, 56 aa, Human herpesvirus 1
SPADSDLLVMWQLTSAPKVHANGPSRIGSHPTYTPTPTGPPGAPAAPLSRTPPSPA

SEQ ID NO: 1952 - protein, 56 aa, Human herpesvirus 1
VLGRNPAEPTSSSPAGPSPPPPAVQPVAPPPTSGPPPTYLTLEGGVAPGGPVSRRP

SEQ ID NO: 1953 - protein, 56 aa, Human herpesvirus 1
ALGAPSVTTALPARRRGRSLVYAGELTPVQTEHGDGVREAIAFLPKREEDAGFDIV

SEQ ID NO: 1954 - protein, 56 aa, Human herpesvirus 1
YQRAPDDQSPSVPNPTPGPVDLVGAEGSLGPGSLAPTLFTDATPGEPVPPRMWAWI

SEQ ID NO: 1955 - protein, 56 aa, Human herpesvirus 1
IGSVALDLAAAAEEISAVRNDPAAAAELVRAGVTLPCPSEDALVACVAALERVDQS

SEQ ID NO: 1956 - protein, 56 aa, Human herpesvirus 1
MASYPGHQHASAFDQAARSRGHSNRRTALRPRRQQEATEVHLEQKMPTLLRVYIDG

SEQ ID NO: 1957 - protein, 39 aa, Human herpesvirus 1
VPDEQPTSPGRGPQETDPLIAVRGERPRLPHICYPVTTL

SEQ ID NO: 1958 - protein, 49 aa, Human herpesvirus 1
RDPRVPRDPRDPRQPRSPREPRSPREPRPPREPRTPRTTREPRTARGAV

SEQ ID NO: 1959 - protein, 56 aa, Human herpesvirus 1
ENQRHPMLPPLAAIHRIDWSAAFGAAADTYADMFRVDTEPLARLLRLAGGLLERAQ

SEQ ID NO: 1960 - protein, 56 aa, Human herpesvirus 1
AFMTLVKQYGPEFVTGYNIINFDWPFLLAKLTDIYKVPLDGYGRMNGRGVFRVWDI

SEQ ID NO: 1961 - protein, 56 aa, Human herpesvirus 1
ELERTFSGKRLLEVMDSLDAKQWSVAQALPCLEPTHPLRRFKTAFDYDQKLLIDLC

SEQ ID NO: 1962 - protein, 56 aa, Human herpesvirus 1
LPCLEPTHPLRRFKTAFDYDQKLLIDLCADRAPYVDHSQSMTLYVTEKADGTLPAS

SEQ ID NO: 1963 - protein, 56 aa, Human herpesvirus 1
MDESRRQRPAGHVAANLSPQGARQRSFKDWLASYVHSNPHGASGRPSGPSLQDAAV

SEQ ID NO: 1964 - protein, 56 aa, Human herpesvirus 1
NHELTLWNEARKLNPNAIASVTVGRRVSARMLGDVMAVSTCVPVAADNVIVQNSMR

SEQ ID NO: 1965 - protein, 56 aa, Human herpesvirus 1
EPLLYRVQALAKFARGEEIRVEAEDRQMREALDALARGVDAVSQHAGPLGVMPAPA

SEQ ID NO: 1966 - protein, 56 aa, Human herpesvirus 1
RAASTLWLLGLDGTDAPPGALTPNDDTEQALDKILRGTMRGGAALIGSPRHHLTRQ

SEQ ID NO: 1967 - protein, 40 aa, Human herpesvirus 1
RAPGRQRLRSSDPPSRHTHRRTPGGACPATQFPPPMSDSE

SEQ ID NO: 1968 - protein, 56 aa, Human herpesvirus 1
PANTQETETRLALYKEIRQALDSRKQAASHTPVKAGCVNFDYSRTRRCVGRQDLGP

SEQ ID NO: 1969 - protein, 56 aa, Human herpesvirus 1
TMTKWQEVDEMLRSEYGGSFRFSSDAISTTFTTNLTEYPLSRVDLGDCIGKDARDA

SEQ ID NO: 1970 - protein, 56 aa, Human herpesvirus 1
PNNMGLIAGAVGGSLLAALVICGIVYWMHRRTRKAPKRIRLPHIREDDQPSSHQPL

SEQ ID NO: 1971 - protein, 56 aa, Human herpesvirus 1
EDEYLSEEMMELTARALERGNGEWSTDAALEVAHEAEALVSQLGNAGEVFNFGDFG

SEQ ID NO: 1972 - protein, 56 aa, Human herpesvirus 1
LIQRGQTLDAPEDLAAWLSVLTDAANQGLIERKPLDELARSIRDINDQQARRSSGL

SEQ ID NO: 1973 - protein, 56 aa, Human herpesvirus 1
PHAPPANHVRLAGLYSPGKYAPLASPDPFSPQHGAYARARVGIHTAVRVPPTGSPT

SEQ ID NO: 1974 - protein, 56 aa, Human herpesvirus 1
RRGSGQENPSPQSTRPPLAPAGAKRAATHPPSDSGPGGRGQGGPGTPLTSSAASAS

SEQ ID NO: 1975 - protein, 39 aa, Human herpesvirus 1
DRARFRRRVAEAEAVIGPCLGPEARARALARGAGPANSV

SEQ ID NO: 1976 - protein, 53 aa, Human herpesvirus 1
MADISPGAFAPCVKARRPALRSPPLGTRKRKRPSRPLSSESEVESDTALESEV

SEQ ID NO: 1977 - protein, 56 aa, Human herpesvirus 1
SHSRIGWDRFVGGVIRRLAARRPGLVFMLWGAHAQNAIRPDPRVHCVLKFSHPSPL

SEQ ID NO: 1978 - protein, 56 aa, Human herpesvirus 1
RHGRWRPSASSTSSDSGSSSSSSASSSSSSSDEDEDDDGNDAADHAREARAVGRGP

SEQ ID NO: 1979 - protein, 56 aa, Influenza A virus; identical to SEQ ID NO: 13

SEQ ID NO: 1980 - protein, 56 aa, Influenza A virus
QDLPGNDNSTATLCLGHHAVPNGTLVKTITNDQIEVTNATELVQSSSTGKICNNPH

SEQ ID NO: 1981 - protein, 56 aa, Influenza A virus
QDLPGNDNSTATLCLGHHAVPNGTLVKTITVDQIEVTNATELVQSSSTGRICNSPH

SEQ ID NO: 1982 - protein, 56 aa, Influenza A virus
QKLPGNDNSTATLLLGHHAVPNGTLVKTITNDQIEVTNATELVQSSSTGRICDSPH

SEQ ID NO: 1983 - protein, 56 aa, Influenza A virus
QDLPGKKNSTATLCLGHHAVPNGTLVKTITDDQIEVTNATELVQSSSTGKICNNPH

SEQ ID NO: 1984 - protein, 56 aa, Influenza A virus
QDLPGNDNSKATLCLGHHAVPNGTLVKTITDDQTEVTNATELVQSSSTGKICNSPH

SEQ ID NO: 1985 - protein, 56 aa, Influenza A virus
LCLGHHAVPNGTLVKTITDDQIEVTNATELVQSSSTGKICNNPHRILDGIDCTLID

SEQ ID NO: 1986 - protein, 56 aa, Influenza A virus
QDLPGNDNSTATLCLGHHAVPNGTLVKTITNDQIEVTNATELVQSSSTGKICDNPH

SEQ ID NO: 1987 - protein, 56 aa, Influenza A virus
QDLPGKSNSTATLCLGHHAVPNGTLVKTITDDQIEVTNATKLVQSSSTGRICNNPH

SEQ ID NO: 1988 - protein, 56 aa, Influenza A virus
LCLGHHAVPNGTLVKTITNDQIEVTNATELVQSSSTGRICDNPHRILDGKNCTLID

SEQ ID NO: 1989 - protein, 56 aa, Influenza A virus
TLCLGHHAVPNGTLVKTITNDQIEVTNATELVQSSSTGKICNNPHRILDGINCTLI

SEQ ID NO: 1990 - protein, 56 aa, Influenza A virus
LCLGHHAVPNGTLVKTITNDQIEVTNATELVQSSSTGKICDNPHRILDGINCTLID

SEQ ID NO: 1991 - protein, 56 aa, Influenza A virus
GHHAVPNGTLVKTITNDQIEVTNATELVQSSSTGRICDSPHRILDGKNCTLIDALL

SEQ ID NO: 1992 - protein, 56 aa, Influenza A virus
EQAAEAMEVASQARQMVQAMRAIGTPPSSSAGLKDDLLENLQAYQKRMGVQMQRFK

SEQ ID NO: 1993 - protein, 56 aa, Influenza A virus
EQAAEAMEIASQARQMVQAMRAIGTHPSSSAGLKDDLLENLQTYQKRMGVQMQRFK

SEQ ID NO: 1994 - protein, 28 aa, Influenza A virus
SSAGLKDNLLENLQAYQKRMGVQMQRFK

SEQ ID NO: 1995 - protein, 28 aa, Influenza A virus
SSTGLKDDLLENLQAYQKRMGVQMQRFK

SEQ ID NO: 1996 - protein, 56 aa, Influenza A virus
LCLGHHAVPNGTLVKTITVDQIEVTNATELVQSSSTGRICNSPHRILDGKDCTLID

SEQ ID NO: 1997 - protein, 28 aa, Influenza A virus
SSTGLRDDLLENLQTYQKRMGVQMQRFK

SEQ ID NO: 1998 - protein, 28 aa, Influenza A virus
SSAGLKDDLLENLQAYQKRMGVQMQRFK

SEQ ID NO: 1999 - protein, 28 aa, Influenza A virus
SSAGLKDDLIENLQAYQKRMGVQMQRFK

SEQ ID NO: 2000 - protein, 56 aa, Influenza A virus
QNLPGNDNSTATLCLGHHAVPNGTLVKTITNDQIEVTNATELVQSSSTGRICDSPH

SEQ ID NO: 2001 - protein, 28 aa, Influenza A virus
SSAGLKDDLLENLQTYQKRMGVQMQRFK

SEQ ID NO: 2002 - protein, 28 aa, Influenza A virus
SSAGLKDDLLENLQAYQKRMGVQMQRFR

SEQ ID NO: 2003 - protein, 56 aa, Influenza A virus
LCLGHHAVPNGTLVKTITNDQIEVTNATELVQSSSTGRICDSPHRILDGKNCTLID

SEQ ID NO: 2004 - protein, 56 aa, Influenza A virus
LCLGHHAVPNGTLVKTITNDQIEVTNATELVQSSSTGKICNNPHRILDGINCTLID

SEQ ID NO: 2005 - protein, 28 aa, Influenza A virus
SSAGLKDDLLENLQAYQKRMGVQIQRFK

SEQ ID NO: 2006 - protein, 52 aa, Influenza A virus
EAMEVANQTRQMVHAMRTIGTHPSSSAGLKDDLLENLQAYQKRMGVQMQRFK

SEQ ID NO: 2007 - protein, 28 aa, Influenza A virus
SSAGLKDDLLENLQTYQKRMGVQVQRFK

SEQ ID NO: 2008 - protein, 56 aa, Influenza A virus
EQAAEAMEIASQARQMVQAMRAIGTHPSSSTGLKDDLLENLQTYQKRMGVQMQRFK

SEQ ID NO: 2009 - protein, 56 aa, Influenza A virus
QKLPGNDNSTATLCLGHHAVPNGTLVKTITNDQIEVTNATELVQSSSTGRICDSPH

SEQ ID NO: 2010 - protein, 56 aa, Influenza A virus
LCLGHHAVPNGTLVKTITNDQIEVTNATELVQSSSTGRICDSPHRILDGKNCTLVD

SEQ ID NO: 2011 - protein, 28 aa, Influenza A virus
SSAGLKNDLLENLQAYQKRMGVQMQRFK

SEQ ID NO: 2012 - protein, 54 aa, Influenza A virus
AAEAMEVANQARQMVQAMRTIGTHPNSSAGLRDNLLENLQAYQKRMGVQMQRFK

SEQ ID NO: 2013 - protein, 56 aa, Influenza A virus
EQAAEAMEVANQTRQMVHAMRTIGTHPSSSAGLKDDLLENLQAYQKRMGVQMQRFK

SEQ ID NO: 2014 - protein, 56 aa, Influenza A virus
PNGTLVKTITNDQIEVTNATELVQSSSTGKICNNPHRILDGINCTLIDALLGDPHC

SEQ ID NO: 2015 - protein, 56 aa, Influenza A virus
EQAAEAMEVASQARQMVQAMRTIGTHPSSSAGLKDDLIENLQAYQKRMGVQMQRFK

SEQ ID NO: 2016 - protein, 56 aa, Influenza A virus
LCLAHHAVPNGTLVKTITNDQIEVTNATELVQSSSTGRICDSPHRILDGKNCTLID

SEQ ID NO: 2017 - protein, 56 aa, Influenza A virus
EQAAEAMEVASQARQMVQAMRAIGTHPSSSTGLKNDLLENLQAYQKRMGVQMQRFK

SEQ ID NO: 2018 - protein, 28 aa, Influenza A virus
SSTGLKDDLLENLQTYQKRMGVQMQRFK

SEQ ID NO: 2019 - protein, 56 aa, Influenza A virus
EQAAEAMEVASQARQMVQAMRAIGTHPSSSAGLKDDLLENLQAYQKRMGVQMQRFK

SEQ ID NO: 2020 - protein, 28 aa, Influenza A virus
SSTGLKNDLLENLQAYQKRMGVQMQRFK

SEQ ID NO: 2021 - protein, 56 aa, Influenza A virus
EQAAEAMEVASQARQMVQAMRAIGTHPSSSAGLKDDLLENLQTYQKRMGVQMQRFK

SEQ ID NO: 2022 - protein, 56 aa, Influenza A virus
LCLGHHAVPNGTLVKTITDDQIEVTNATELVQNFSMDKICNNPHRILDGANCTLID

SEQ ID NO: 2023 - protein, 28 aa, Influenza A virus
SSAGLRDNLLENLQAYQKRMGVQMQRFK

SEQ ID NO: 2024 - protein, 56 aa, Influenza A virus
EQAAEAMEIANQARQMVQAMRTVGTHPNSSTGLKDDLLENLQAYQKRMGVQMQRFK

SEQ ID NO: 2025 - protein, 28 aa, Influenza A virus
SSAGLKSDLLENLQAYQKRMGVQMQRFK

SEQ ID NO: 2026 - protein, 56 aa, Influenza A virus
EQAAEAMEVASQARQMVQAMRTIGTHPSSSAGLKDDLLENLQAYQKRMGVQMQRFK

SEQ ID NO: 2027 - protein, 56 aa, Influenza A virus
EQAAEAMEIASQARQMVQAMRAIGTHPSSSTGLRDDLLENLQTYQKRMGVQMQRFK

SEQ ID NO: 2028 - protein, 56 aa, Influenza A virus
EQAAEAMEVASQTRQMVQAMRAIGTHPSSSAGLKNDLLENLQAYQKRMGVQMQRFK

SEQ ID NO: 2029 - protein, 49 aa, Influenza A virus
CITPNGSIPNDKPFQNVNKITYGACPKYVKQNTLKLATGMRNVPEKQTR

SEQ ID NO: 2030 - protein, 56 aa, Influenza A virus
EQAAEAMEVASQTRQMVQAMRTIGTHPSSSAGLKDNLLENLQAYQKRMGVQMQRFK

SEQ ID NO: 2031 - protein, 56 aa, Influenza A virus
TNPLIRHENRMVLASTTAKAMEQMAGSSEQAAEAMEVASQTRQMVQAMRAIGTHPS

SEQ ID NO: 2032 - protein, 56 aa, Influenza A virus
EQAAEAMEVASQARQMVHAMRTIGTHPSSSAGLKDDLLENLQAYQKRMGVQIQRFK

SEQ ID NO: 2033 - protein, 56 aa, Influenza A virus
EQAAEAMEIASQARQMVQAMRAIGTHPSSSAGLKDDLLENLQTYQKRMGVQVQRFK

SEQ ID NO: 2034 - protein, 56 aa, Influenza A virus
LCLGHHAVPNGTLVKTITNDQIEVTNATELVQSSSTGKICNNPHRILDGIDCTLID

SEQ ID NO: 2035 - protein, 56 aa, Influenza A virus
EQAAEAMEVASQARQMVQAMRAIGTHPSSSAGLKNDLLENLQAYQKRMGVQMQRFK

SEQ ID NO: 2036 - protein, 53 aa, Influenza A virus
AEAMEVASQARQMVQAMRTIGTHPSSSAGLKNDLLENLQAYQKRMGVQMQRFK

SEQ ID NO: 2037 - protein, 56 aa, Influenza A virus
TNPLIRHENRMVLASTTAKAMEQMAGSNEQAAEAMEIANQARQMVQAMRTVGTHPN

SEQ ID NO: 2038 - protein, 49 aa, Influenza A virus
CITPNGSIPNDKPFQNVNRITYGACPRYVKQNTLKLATGMRNVPEKQTR

SEQ ID NO: 2039 - protein, 49 aa, Influenza A virus
CITPNGNIPNDKPFQNVNKITYGACPKYVKQNTLKLATGMRNIPEKQTR

SEQ ID NO: 2040 - protein, 53 aa, Influenza A virus
AEAMEVASQARQMVQAMRAIGTHPSSSTGLKNDLLENLQAYQKRMGVQMQRFK

SEQ ID NO: 2041 - protein, 56 aa, Influenza A virus
PIGTCSSECITPNGSIPNDKPFQNVNKITYGACPKYVKQNTLKLATGMRNVPEKQT

SEQ ID NO: 2042 - protein, 39 aa, Influenza A virus
QNVNKITYGACPRYVKQNTLKLATGMRNVPEKQTRGIFG

SEQ ID NO: 2043 - protein, 56 aa, Influenza A virus
EAAFGLVCATCEQIADSQHRSHRQMTTTTNPLIRHENRMVLASTTAKAMEQMAGSS

SEQ ID NO: 2044 - protein, 56 aa, Influenza A virus
TNPLIRHENRMVLASTTAKAMEQMAGSSEQAAEAMEIASQARQMVQAMRAIGTHPS

SEQ ID NO: 2045 - protein, 56 aa, Influenza A virus
EQAAEAMEVASQARQMVQAMRTIGTHPSSSAGLKNDLLENLQAYQKRMGVQMQRFK

SEQ ID NO: 2046 - protein, 56 aa, Influenza A virus
EQAAEAMEVASQARQMVQAMRAIGTHPRSSAGLKDDLLENLQAYQKRMGVQMQRFK

SEQ ID NO: 2047 - protein, 56 aa, Influenza A virus
TNPLIRHENRMVLASTTAKAMEQMAGSSEQAAEAMEVASQARQMVQAMRAIGTHPS

SEQ ID NO: 2048 - protein, 56 aa, Influenza A virus
TNPLIRHENRMVLASTTAKAMEQMAGSSEQAAEAMEVASQARQMVQAMRAIGTHPR

SEQ ID NO: 2049 - protein, 56 aa, Influenza A virus
EQAAEAMEVASQARQMVQAMRTIGTHPSSSAGLKDNLLENLQAYQKRMGVQMQRFK

SEQ ID NO: 2050 - protein, 56 aa, Influenza A virus
EQAAEAMEVASQARQMVQAMRAIGTHPSSSAGLKSDLLENLQAYQKRMGVQMQRFK

SEQ ID NO: 2051 - protein, 56 aa, Influenza A virus
TNPLIRHENRMVLASTTAKAMEQMAGSSEQAAEAMEVASQARQMVQAMRTIGTHPS

SEQ ID NO: 2052 - protein, 56 aa, Influenza A virus
PFQNVNRITYGACPRYVKQNTLKLATGMRNVPEKQTRGIFGAIAGFIENGWEGMVD

SEQ ID NO: 2053 - protein, 48 aa, Influenza A virus
CITPNGSIPNDKPFQNVNKITYGACPKYVKQNTLKLATGMRNVPEKQT

SEQ ID NO: 2054 - protein, 56 aa, Influenza A virus
TNPLIRHENRMVLASTTAKAMEQMAGSSEQAAEAMEVANQARQMVQAMRTIGTHPN

SEQ ID NO: 2055 - protein, 56 aa, Influenza A virus
CITPNGSIPNDKPFQNVNKITYGACPKYVKQNSLKLATGMRNVPEKQTRGLFGAIA

SEQ ID NO: 2056 - protein, 56 aa, Influenza A virus
VQRNLPFDKPTIMAAFTGNAEGRTSDMRAEIIRMMEGAKPEEVSFQGRGVFELSDE

SEQ ID NO: 2057 - protein, 56 aa, Influenza A virus
QKLPGNDNSTATLCLGHHAVPNGTIVKTITNDQIEVTNATELVQSSSTGEICDSPH

SEQ ID NO: 2058 - protein, 53 aa, Influenza A virus
CITPNGSIPNDKPFQNVNRITYGACPRYVKQNTLKLATGMRNVPEKQTRGIFG

SEQ ID NO: 2059 - protein, 56 aa, Influenza A virus
DAPFSDRLRRDQKALKGRGSTLGLDLRVATMEGKKIVEDILKNETDENLKIAIASS

SEQ ID NO: 2060 - protein, 56 aa, Influenza A virus
TNPLIRHENRMVLASTTAKAMEQMAGSSEQAAEAMEVASQARQMIQAMRTIGTHPS

SEQ ID NO: 2061 - protein, 56 aa, Influenza A virus
TNPLIRHENRMVLASTTAKAMEQMAGSSEQAAEAMEVANQTRQMVHAMRTIGTHPS

SEQ ID NO: 2062 - protein, 26 aa, Influenza A virus
LATGMRNVPEKQTRGLFGAIAGFIEN

SEQ ID NO: 2063 - protein, 56 aa, Influenza A virus
DAPFDDRLRRDQKALKGRGSTLGLDLRVATMEGKKIVEDILKSETNENLKIAIASS

SEQ ID NO: 2064 - protein, 56 aa, Influenza A virus
EQAAEAMEVASQARQMVQAMRTIGTHPSSSAGLKDDLLENLQAYQKRMGVQMQRFR

SEQ ID NO: 2065 - protein, 56 aa, Influenza A virus
TNPLIRHENRMVLASTTAKAMEQMAGSSEQAAEAMEVASQTRQMVQAMRTIGTHPS

SEQ ID NO: 2066 - protein, 56 aa, Influenza A virus
CITPNGSIPNDKPFQNVNRITYGACPRYVKQNTLKLATGMRNVPEKQTRGIFGAIA

SEQ ID NO: 2067 - protein, 56 aa, Influenza A virus
PLIRHENRMVLASTTAKAMEQMAGSSEQAAEAMEVANQARQMVQAMRTIGTHPNSS

SEQ ID NO: 2068 - protein, 44 aa, Influenza A virus
NEQGSGYAADKESTQKAIDGVTNKVNSIIDKMNTQFEAVGREFN

SEQ ID NO: 2069 - protein, 56 aa, Influenza A virus
EVAFGLVCATCEQIADSQHRAYRQMATTTNPLIRHENRMVLASTTAKAMEQMAGSN

SEQ ID NO: 2070 - protein, 56 aa, Influenza A virus
PFQNVNKITYGACPKYVKQNTLKLATGMRNIPEKQTRGIFGAIAGFIENGWEGMVD

SEQ ID NO: 2071 - protein, 56 aa, Influenza A virus
PFQNVNKITYGACPKYVKQNTLKLATGMRNVPEKQTRGLFGAIAGFIENGWEGMID

SEQ ID NO: 2072 - protein, 56 aa, Influenza A virus
MEQEQDTPWTQSTEHINIQKKGNGQQTQRLEHLNSTQLTDHYLKIMSQADMHRQTV

SEQ ID NO: 2073 - protein, 56 aa, Influenza A virus
INDRNFWRGENGRRTRIAYERMCNILKGKFQTAAQRAMMDQVRESRNPGNAEIEDL

SEQ ID NO: 2074 - protein, 48 aa, Influenza A virus
CITPNGSIPNDKPFQNVNRITYGACPRYVKQNTLKLATGMRNVPEKQT

SEQ ID NO: 2075 - protein, 56 aa, Influenza A virus
LCLGHHAVPNGTIVKTITDDQIEVTNATELVQSSSTGKICNNPHRILDGRDCTLID

SEQ ID NO: 2076 - protein, 56 aa, Influenza A virus
PFQNVNKITYGACPKYVKQNSLKLATGMRNVPEKQTRGLFGAIAGFIENGWEGMID

SEQ ID NO: 2077 - protein, 49 aa, Influenza A virus
CITPNGSIPNDKPFQNVNKITYGACPRYVKQNTLKLATGMRNVPEKQTR

SEQ ID NO: 2078 - protein, 56 aa, Influenza A virus
PFQNVNKITYGACPKYVKQNTLKLATGMRNVPEKQTRGIFGAIAGFIENGWEGMID

SEQ ID NO: 2079 - protein, 56 aa, Influenza A virus
PFQNVNKITYGACPKYVKQNTLKLATGMRNVPEKQTRGIFGAIAGFIENGWEGMVD

SEQ ID NO: 2080 - protein, 56 aa, Influenza A virus
NGNGDPNNMDRAVKLYKKLKREMTFHGAKEVALSYSTGALASCMGLIYNRMGTVTT

SEQ ID NO: 2081 - protein, 50 aa, Influenza A virus
ESARPEDVSFQGRGVFELSDEKATNPIVPSFDMNNEGSYFFGDNAEEYDN

SEQ ID NO: 2082 - protein, 56 aa, Influenza A virus
EAAFGLVCATCEQIADSQHRSHRQMATTTNPLIRHENRMVLASTTAKAMEQMAGSS

SEQ ID NO: 2083 - protein, 56 aa, Influenza A virus
TNPLIRHENRMVLASTTAKAMEQMAGSSEQAAEAMEVASQARQMVQAMRAIGTPPS

SEQ ID NO: 2084 - protein, 56 aa, Influenza A virus
STDTVDTVLEKNVTVTHSVNLLEDKHNGKLCKLRGVAPLHLGKCNIAGWILGNPEC

SEQ ID NO: 2085 - protein, 26 aa, Influenza A virus
MKNVPELPKKRRKRGLFGAIAGFIEN

SEQ ID NO: 2086 - protein, 56 aa, Influenza A virus
MSLLTEVETYVLSIVPSGPLKAEIAQRLQDVFAGKNTDLEALMEWLKTRPILSPLT

SEQ ID NO: 2087 - protein, 56 aa, Influenza A virus
MSLLTEVETYVLSIVPSGPLKAEIAQRLEDVFAGKNTDLEALTEWLKTRPILSPLT

SEQ ID NO: 2088 - protein, 56 aa, Influenza A virus
TCISECITPNGSIPNDKPFQNVNKITYGACPKYVKQNTLKLATGMRNVPEKQTRGL

SEQ ID NO: 2089 - protein, 50 aa, Influenza A virus
ESARPEDVSFQGRGVFELSDEKATNPIVPSFDMSNEGSYFFGDNAEEYDN

SEQ ID NO: 2090 - protein, 56 aa, Influenza A virus
EQAAEAMEVASQARQMIQAMRTIGTHPSSSAGLKDDLLENLQAYQKRMGVQMQRFK

SEQ ID NO: 2091 - protein, 56 aa, Influenza A virus
IGNGCFEFYHKCDNECMESVRNGTYDYPKYSEESKLNREKIDGVKLESMGVYQILA

SEQ ID NO: 2092 - protein, 56 aa, Influenza A virus
LCLGHHAVPNGTIVKTITDDQIEVTNATELVQSSSTGKICNNPHKILDGRDCTLID

SEQ ID NO: 2093 - protein, 56 aa, Influenza A virus
LTEVETYVLSIVPSGPLKAEIAQRLEDVFAGKNTDLEALMEWLKTRPILSPLTKGI

SEQ ID NO: 2094 - protein, 56 aa, Influenza A virus
STDTVDTVLEKNVTVTHSVNLLEDSHNGKLCRLKGIAPLQLGKCNIAGWLLGNPEC

SEQ ID NO: 2095 - protein, 49 aa, Influenza A virus
CITPNGSIPNDKPFQNVNKITYGACPKYIKQNTLKLATGMRNIPEKQTR

SEQ ID NO: 2096 - protein, 47 aa, Influenza A virus
TPKGAINTSLPFQNIHPVTIGECPKYVKSTKLRMATGLRNIPSIQSR

SEQ ID NO: 2097 - protein, 47 aa, Influenza A virus
TPRGALNSSLPFQNIHPITIGECPKYVKSTKLRMATGLRNVPSIQSR

SEQ ID NO: 2098 - protein, 56 aa, Influenza A virus
DTICVGYHANNSTDTVDTVLEKNVTVTHSVNLLENSHNGKLCSLNGIAPLQLGKCN

SEQ ID NO: 2099 - protein, 56 aa, Influenza A virus
CITPNGSIPNDKPFQNVNKITYGACPRYVKQNTLKLATGMRNVPEKQTRGIFGAIA

SEQ ID NO: 2100 - protein, 56 aa, Influenza A virus
VKQNSLKLATGMRNVPEKQTRGLFGAIAGFIENGWEGMIDGWYGFRHQNSEGTGQA

SEQ ID NO: 2101 - protein, 56 aa, Influenza A virus
STDTVDTVLEKNVTVTHSVNLLEDSHNGKLCRLKGIAPLQLGKCNIAGWILGNPEC

SEQ ID NO: 2102 - protein, 56 aa, Influenza A virus
NVPSIQSRGLFGAIAGFIEGGWTGMIDGWYGYHHQNEQGSGYAADQKSTQNAIDGI

SEQ ID NO: 2103 - protein, 56 aa, Influenza A virus
EGAFGLVCATCEQIADSQHRSHRQMATTTNPLIRHENRMVLASTTAKAMEQMAGSS

SEQ ID NO: 2104 - protein, 50 aa, Influenza A virus
ESARPEDLSFQGRGVFELSDEKATNPIVPSFDMSNEGSYFFGDNAEEFES

SEQ ID NO: 2105 - protein, 48 aa, Influenza A virus
ACPKYVKQNTLKLATGMRNVPEKQTRGLFGAIAGFIENGWEGMIDGWY

SEQ ID NO: 2106 - protein, 56 aa, Influenza A virus
DAPFLDRLRRDQKSLKGRGSTLGLDIETATHAGKQIVERILEEESDEALKMTIASV

SEQ ID NO: 2107 - protein, 56 aa, Influenza A virus
FGLICATCEQIADSQHKSHRQMVTTTNPLIRHENRMVLASTTAKAMEQMAGSSEQA

SEQ ID NO: 2108 - protein, 56 aa, Influenza A virus
KIQWSQNPTMLYNKLEFEPFQSLVPKAIRGQYSGFVRTLFQQMRDVLGTFDTTQII

SEQ ID NO: 2109 - protein, 56 aa, Influenza A virus
YAFAMNRGSGSGIITSDAPVHDCDTKCQTPQGAINSSLPFQNIHPVTIGECPKYVK

SEQ ID NO: 2110 - protein, 56 aa, Influenza A virus
STDTVDTVLEKNVTVTHSVNLLEDSHNGKLCRLKGTAPLQLGNCSVAGWILGNPEC

SEQ ID NO: 2111 - protein, 47 aa, Influenza A virus
TPQGAINSSLPFQNIHPVTIGECPKYVKSTKLRMATGLRNIPSIQSR

SEQ ID NO: 2112 - protein, 56 aa, Influenza A virus
LIRHENRMVLASTTAKAMEQMAGSSEQAAEAMEVASQARQMVQAMRTIGTHPSSSA

SEQ ID NO: 2113 - protein, 56 aa, Influenza A virus
DKPTIMAAFTGNTEGRTSDMRTEIIRMMEGAKPEEMSFQGRGVFELSDEKATNPIV

SEQ ID NO: 2114 - protein, 56 aa, Influenza A virus
GLVCATCEQIADSQHRSHRQMATTTNPLIRHENRMVLASTTAKAMEQMAGSSEQAA

SEQ ID NO: 2115 - protein, 56 aa, Influenza A virus
TNPLIRHENRMVLASTTAKAMEQMAGSSEQAAEAMEVASQARQMVQAMRTIGTHPN

SEQ ID NO: 2116 - protein, 56 aa, Influenza A virus
EQAAEAMEVANQARQMVQAMRTIGTHPNSSAGLRDNLLENLQAYQKRMGVQMQRFK

SEQ ID NO: 2117 - protein, 56 aa, Influenza A virus
STDTVDTVLEKNVTVTHSVNLLENSHNGKLCSLNGIAPLQLGKCNVAGWLLGNLEC

SEQ ID NO: 2118 - protein, 56 aa, Influenza A virus
STDTVDTVLEKNVTVTHSVNLLEDSHNGKLCRLKGIAPLQLGNCSIAGWILGNPEC

SEQ ID NO: 2119 - protein, 56 aa, Influenza A virus
LQQIESMIEAESSVKEKDMTKEFFENKTETWPIGESPRGVEEGSIGKVCRTLLAKS

SEQ ID NO: 2120 - protein, 56 aa, Influenza A virus
DMGNGCFKIYHKCDNACIESIRNGTYDHNEYRDEALNNRFQIKGVELKSGYKDWIL

SEQ ID NO: 2121 - protein, 56 aa, Influenza A virus
TYGACPKYVKQNTLKLATGMRNVPEKQTRGIFGAIAGFIENGWEGMIDGWYGFRHQ

SEQ ID NO: 2122 - protein, 45 aa, Influenza A virus
FSVQRNLPFDKSTIMAAFTGNTEGRTSDMRAEIIRMMEGAKPEEM

SEQ ID NO: 2123 - protein, 56 aa, Influenza A virus
EVAFGLVCATCEQIADSQHRSLRQMVATTNPLIRHENRMVLASTTAKAMEQMAGSS

SEQ ID NO: 2124 - protein, 56 aa, Influenza A virus
NERTLDFHDSNVKNLYDKVRLQLRDNAKELGNGCFEFYHKCDNECMESVRNGTYDY

SEQ ID NO: 2125 - protein, 56 aa, Influenza A virus
AFGLVCATCEQIADSQHRSHRQMATITNPLIRHENRMVLASTTAKAMEQMAGSSEQ

SEQ ID NO: 2126 - protein, 36 aa, Influenza A virus
FQNVHPVTIGECPKYVRSTKLRMVTGLRNIPSIQSR

SEQ ID NO: 2127 - protein, 35 aa, Influenza A virus
FQNVHPVTIGECPKYVKSTKLRMVTGLRNIPSIQS

SEQ ID NO: 2128 - protein, 56 aa, Influenza A virus
NGNGDPNNMDRAVKLYRKLKREITFHGAKEVALSYSTGALASCMGLIYNRMGTVTT

SEQ ID NO: 2129 - protein, 56 aa, Influenza A virus
YAFALNKGSDSGIITSDAPVHNCDTRCQTPHGALNSSLPFQNVHPITIGECPKYVK

SEQ ID NO: 2130 - protein, 56 aa, Influenza A virus
DGWYGYHHSNEQGSGYAADKESTQKAIDGVTNKVNSIIDKMNTQFEAVGREFNNLE

SEQ ID NO: 2131 - protein, 56 aa, Influenza A virus
YAFALNKGSGSGIITSDTPVHNCDTKCQTPHGALNSSLPFQNVHPITIGECPKYVK

SEQ ID NO: 2132 - protein, 56 aa, Influenza A virus
NNTATLCLGHHAVPNGTIVKTITDDQIEVTNATELVQSSSTGKICNNPHRILDGGN

SEQ ID NO: 2133 - protein, 56 aa, Influenza A virus
RENAEDMGNGCFKIYHNCDNACIESIRNGTYDHNIYRDEALNNRFQIKGVELKSGY

SEQ ID NO: 2134 - protein, 56 aa, Influenza A virus
GIITSDAPVHNCDTRCQTPHGALNSSLPFQNVHPITIGECPKYVKSTKLRMATGLR

SEQ ID NO: 2135 - protein, 50 aa, Influenza A virus
ENARPEDVSFQGRGVFELSDEKATNPIVPSFDMSNEGSYFFGDNAEEYDN

SEQ ID NO: 2136 - protein, 56 aa, Influenza A virus
DTLCIGYHANNSTDTVDTVLEKNVTVTHSVNLLEDSHNGKLCRLGGIAPLQLGKCN

SEQ ID NO: 2137 - protein, 56 aa, Influenza A virus
ESAFGLICATCEQIADSQHKSHRQMVITTNPLIRHENRMVLASTTAKAMEQMAGSS

SEQ ID NO: 2138 - protein, 36 aa, Influenza A virus
FQNIHPVTIGECPKYVKSTKLRMVTGLRNIPSIQSR

SEQ ID NO: 2139 - protein, 56 aa, Influenza A virus
DTLCIGYHANNSTDTVDTVLEKNVTVTHSVNLLEDRHNGKLCKLRGVAPLHLGKCN

SEQ ID NO: 2140 - protein, 56 aa, Influenza A virus
YAFALNKDSGSGIITSDAPVHNCDTKCQTPRGALNSSLPFQNIHPITIGECPKYVK

SEQ ID NO: 2141 - protein, 56 aa, Influenza A virus
STDTVDTVLEKNVTVTHSVNLLEDSHNGKLCLLKGIAPLQLGNCSVAGWILGNPEC

SEQ ID NO: 2142 - protein, 50 aa, Influenza A virus
ESARPEDVSFQGRGVFELSDEKATNPIVPSFDMSNEGSYFFGDNAEEYEN

SEQ ID NO: 2143 - protein, 34 aa, Influenza A virus
SWKQWLSLKNPTQGSLKTRALKQWKLFNKQGWTD

SEQ ID NO: 2144 - protein, 56 aa, Influenza A virus
GIIISDTPIHDCDTTCQTPKGAINTSLPFQNIHPVTIGECPKYVKSTKLRMATGLR

SEQ ID NO: 2145 - protein, 28 aa, Influenza A virus
SSTGLRDNLLENLQAYQNRMGVQMQRFK

SEQ ID NO: 2146 - protein, 56 aa, Influenza A virus
GWYGYHHSNEQGSGYAADKESTQKAIDGVTNKVNSIIDKMNTQFEAVGREFNNLER

SEQ ID NO: 2147 - protein, 56 aa, Influenza A virus
IEAESSVKEKDMTKEFFENKSETWPIGESPKGVEEGSIGKVCRTLLAKSVFNSLYA

SEQ ID NO: 2148 - protein, 56 aa, Influenza A virus
KKMEDGFLDVWTYNAELLVLMENERTLDFHDSNVKNLYDKVRMQLRDNAKEIGNGC

SEQ ID NO: 2149 - protein, 56 aa, Influenza A virus
FQNVHPITIGECPKYVKSTKLRMATGLRNVPSIQSRGLFGAIAGFIEGGWTGMIDG

SEQ ID NO: 2150 - protein, 56 aa, Influenza A virus
IITSNAPMDKCDAKCQTPQGAINSSLPFQNVHPVTIGECPKYVRSTKLRMVTGLRN

SEQ ID NO: 2151 - protein, 56 aa, Influenza A virus
GGNTTQQRASAGQISVQPTFSVQRNLPFDKPTIMAAFTGNTEGRTSDMRAEIIRMM

SEQ ID NO: 2152 - protein, 56 aa, Influenza A virus
STDTVDTVLEKNVTVTHSVNLLEDSHNGKLCRLKGIAPLQLGKCSIAGWILGNPEC

SEQ ID NO: 2153 - protein, 56 aa, Influenza A virus
EVAFGLVCATCEQIADSQHRAHRQMATTTNPLIRHENRMVLASTTAKAMEQMAGSN

SEQ ID NO: 2154 - protein, 56 aa, Influenza A virus
ESAFGLICATCEQIADSQHKSHRQMVTTTNPLIRHENRMVLASTTAKAMEQMAGSS

SEQ ID NO: 2155 - protein, 56 aa, Influenza A virus
DTICVGYHANNSTDTVDTVLEKNVTVTHSVNLLEDSHNGKLCSLNGIAPLQLGKCN

SEQ ID NO: 2156 - protein, 56 aa, Influenza A virus
STDTVDTVLEKNVTVTHSVNLLENSHNGKLCSLNGIAPLQLGKCNVAGWLLGNPEC

SEQ ID NO: 2157 - protein, 56 aa, Influenza A virus
DAPFLDRLRRDQKSLKGRGSTLGLNIETATIAGKQIVEWILKEESNETLKMTIASV

SEQ ID NO: 2158 - protein, 56 aa, Influenza A virus
EVAFGLVCATCEQIADSQHRSHRQMVITTNPLIRHENRMVLASTTAKAMEQMAGSS

SEQ ID NO: 2159 - protein, 56 aa, Influenza A virus
STDTVDTILEKNVTVTHSVNLLENSHNGKLCSLNGVAPLQLGKCNVAGWILGNPEC

SEQ ID NO: 2160 - protein, 56 aa, Influenza A virus
TEQVDTIMEKNVTVTHAQDILERTHNGKLCDLNGVKPLILRDCSVAGWLLGNPMCD

SEQ ID NO: 2161 - protein, 56 aa, Influenza A virus
STDTVDTVLEKNVTVTHSVNLLEDRHNGKLCKLGGIAPLHLGKCNIAGWLLGNPEC

SEQ ID NO: 2162 - protein, 56 aa, Influenza A virus
TEQVDTIMEKNVTVTHAQDILEKTHNGKLCDLNGVKPLILRDCSVAGWLLGNPMCD

SEQ ID NO: 2163 - protein, 49 aa, Influenza A virus
CITPNGSIPNDKPFQNINKITYGACPKYVKQNTLKLATGMRNVPEKQTR

SEQ ID NO: 2164 - protein, 56 aa, Influenza A virus
EQAAEAMEVASQARQMVQAMRTIGTHPNSSTGLRDNLLENLQAYQNRMGVQMQRFK

SEQ ID NO: 2165 - protein, 56 aa, Influenza A virus
EVALGLVCATCEQIADSQHRSHRQMATATNPLIRHENRMVLASTTAKAMEQMAGSS

SEQ ID NO: 2166 - protein, 56 aa, Influenza A virus
LCLGHHAVPNGTIVKTITNDQIEVTNATELVQSSSTGEICDSPHQILDGENCTLID

SEQ ID NO: 2167 - protein, 56 aa, Influenza A virus
DAPFLDRLRRDQKSLKGRGSTLGLDIETATRAGKQIVKRILEEESDEAFKMTIAYV

SEQ ID NO: 2168 - protein, 56 aa, Influenza A virus
STDTVDTVLEKNVTVTHSVNLLEDSHNGKLCRLGGIAPLQLGKCNIAGWLLGNPEC

SEQ ID NO: 2169 - protein, 56 aa, Influenza A virus
LLTEVETYVLSIIPSGPLKAEIAQRLESVFAGKNTDLEALMEWLKTRPILSPLTKG

SEQ ID NO: 2170 - protein, 56 aa, Influenza A virus
NGNGDPNNMDRAVKLYRKLKREITFHGAKEVALSYSAGALASCMGLIYNRMGAVTT

SEQ ID NO: 2171 - protein, 56 aa, Influenza A virus
TEQVDTIMEKNVTVTHAQDILEKTHNGKLCDLDGVKPLILRDCSVAGWLLGNPMCD

SEQ ID NO: 2172 - protein, 56 aa, Influenza A virus
FGLVCATCEQIADSQHRSHRQMVTTTNPLIRHENRMVLASTTAKAMEQMAGSSEQA

SEQ ID NO: 2173 - protein, 56 aa, Influenza A virus
DKPTIMAAFTGNTEGRTSDMRAEIIRMMEGAKPEEMSFQGRGVFELSDEKATNPIV

SEQ ID NO: 2174 - protein, 50 aa, Influenza A virus
EGAKPEEMSFQGRGVFELSDEKATNPIVPSFDMSNEGSYFFGDNAEEYDN

SEQ ID NO: 2175 - protein, 37 aa, Influenza A virus
ESARPEDVSFQGRGVFELSDEKATNPIVPSFDMNNEG

SEQ ID NO: 2176 - protein, 56 aa, Influenza A virus
NSSRKGFEMIWDPNGWTDTDDNFLVKQDVVAMTDWSGYSGSFVQHPELTGLDCMRP

SEQ ID NO: 2177 - protein, 56 aa, Influenza A virus
IKRGINDRNFWRGENGRRTRIAYERMCNILKGKFQTAAQRAMMDQVREGRNPGNAE

SEQ ID NO: 2178 - protein, 56 aa, Influenza A virus
KELGNGCFEFYHKCDNECMESVRNGTYDYPQYSEEARLKREEISGVKLESIGTYQI

SEQ ID NO: 2179 - protein, 56 aa, Influenza A virus
DAPFLDRLRRDQKSLKGRGSTLGLDIETATCVGKQIVERILKEESDEALKMTMASA

SEQ ID NO: 2180 - protein, 56 aa, Influenza A virus
ERATVMAAFIGDNEGRTSDMRTEIIRMMESAKPEDLSFQGRGVFELSDEKATNPIV

SEQ ID NO: 2181 - protein, 56 aa, Influenza A virus
EVAFGLVCATCEQIADSQHRSHRQMATTTNPLIRHENRMVLASTTAKAMEQMAGSS

SEQ ID NO: 2182 - protein, 56 aa, Influenza A virus
MDSHTVSSFQVDCFLWHVRKQVADQDLGDAPFLDRLRRDQKSLKGRGSTLGLNIET

SEQ ID NO: 2183 - protein, 56 aa, Influenza A virus
TEGTLENCETKCQTPLGAINTTLPFHNVHPLTIGECPKYVKSEKLVLATGLRNVPQ

SEQ ID NO: 2184 - protein, 56 aa, Influenza A virus
EVAFGLVCATCEQIADSQHRSHRQMVATTNPLIRHENRMVLASTTAKAMEQMAGSS

SEQ ID NO: 2185 - protein, 34 aa, Influenza A virus
NIQRFAWGIRDEDGGPPLPPKQKRYMARRVESEV

SEQ ID NO: 2186 - protein, 56 aa, Influenza A virus
IKRGINDRNFWRGENGRKTRSAYERMCNILKGKFQTAAQRAMMDQVRESRNPGNAE

SEQ ID NO: 2187 - protein, 56 aa, Influenza A virus
STDTVDTVLEKNVTVTHSVNLLENSHNGKLCLLKGIAPLQLGNCSVAGWILGNPEC

SEQ ID NO: 2188 - protein, 56 aa, Influenza A virus
MDSHTVSSFQVDCFLWHVRKQAADQDLGDAPFLDRLRRDQKSLKGRGSTLGLNIET

SEQ ID NO: 2189 - protein, 56 aa, Influenza A virus
LIRHENRMVLASTTAKAMEQMAGSSEQAAEAMEVASQARQMVQAMRAIGTHPSSST

SEQ ID NO: 2190 - protein, 56 aa, Influenza A virus
DKSTVMAAFTGNTEGRTSDMRAEIIRMMEGAKPEEVSFRGRGVFELSDEKATNPIV

SEQ ID NO: 2191 - protein, 50 aa, Influenza A virus
ENARSEDVSFQGRGVFELSDEKATNPIVPSFDMSNEGSYFFGDNAEEFDS

SEQ ID NO: 2192 - protein, 56 aa, Influenza A virus
EKNVTVTHAQDILEKTHNGKLCDLDGVKPLILRDCSVAGWLLGNPMCDEFINVPEW

SEQ ID NO: 2193 - protein, 56 aa, Influenza A virus
HDSNVKNLYDKVRLQLRDNAKELGNGCFEFYHKCDNECMESVRNGTYDYPQYSEEA

SEQ ID NO: 2194 - protein, 56 aa, Influenza A virus
EKTKKQLRENAEDMGNGCFKIYHKCDNACIGSIRNGTYDHDVYRDEALNNRFQIKG

SEQ ID NO: 2195 - protein, 44 aa, Influenza A virus
RLKYGLKRGPSTEGVPESMREEYRQEQQSAVDVDDGHFVNIELE

SEQ ID NO: 2196 - protein, 50 aa, Influenza A virus
ESAKPEDLSFQGRGVFELSDEKATNPIVPSFDMSNEGSYFFGDNAEEYDN

SEQ ID NO: 2197 - protein, 56 aa, Influenza A virus
EVAFGLVCATCEQIADSQHRSHRQMVTTTNPLIRHENRMVLASTTAKAMEQMAGSS

SEQ ID NO: 2198 - protein, 32 aa, Influenza A virus
HPLTIGECPKYVKSEKLVLATGLRNVPQIESR

SEQ ID NO: 2199 - protein, 56 aa, Influenza A virus
SLVKSDQICIGYHANNSTEQVDTIMEKNVTVTHAQDILEKTHNGKLCDLDGVKPLI

SEQ ID NO: 2200 - protein, 33 aa, Influenza A virus
RSTKLRMVTGLRNIPSIQSRGLFGAIAGFIEGG

SEQ ID NO: 2201 - protein, 56 aa, Influenza A virus
STDTVDTVLEKNVTVTHSVNLLEDSHNGKLCKLKGIAPLQLGKCNIAGWLLGNPEC

SEQ ID NO: 2202 - protein, 56 aa, Influenza A virus
ISNLPFQNINSRAVGKCPRYVKQESLLLATGMKNVPEIPKGRGLFGAIAGFIENGW

SEQ ID NO: 2203 - protein, 56 aa, Influenza A virus
MGQEQDTPWILSTGHISTQKREDGQQTPRLEHHNSTRLMDHCQKTMNQVVMPKQIV

SEQ ID NO: 2204 - protein, 50 aa, Influenza A virus
EDAKPEEVSFRGRGVFELSDEKATNPIVPSFDMSNEGSYFFGDNAEEYDN

SEQ ID NO: 2205 - protein, 56 aa, Influenza A virus
VDTVLEKNVTVTHSVNLLEDSHNGKLCRLKGIAPLQLGKCNIAGWLLGNPECDPLL

SEQ ID NO: 2206 - protein, 56 aa, Influenza A virus
EVALGLVCATCEQIADAQHRSHRQMATTTNPLIRHENRMVLASTTAKAMEQMAGSS

SEQ ID NO: 2207 - protein, 56 aa, Influenza A virus
FQNIHPVTIGECPKYVKSTKLRMATGLRNIPSIQSRGLFGAIAGFIEGGWTGMIDG

SEQ ID NO: 2208 - protein, 56 aa, Influenza A virus
LQQIESMIEAESSVKEKDMTKEFFENRSETWPIGESPKGVEEGSIGKVCRTLLAKS

SEQ ID NO: 2209 - protein, 56 aa, Influenza A virus
WAIRTRSGGNTNQQRASAGQISVQPTFSVQRNLPFDKPTIMAAFTGNAEGRTSDMR

SEQ ID NO: 2210 - protein, 56 aa, Influenza A virus
IKRGINDRNFWRGENGRKTRIAYERMCNILKGKFQAAAQRAMMDQVRESRNPGNAE

SEQ ID NO: 2211 - protein, 56 aa, Influenza A virus
AWKQVLAELQDIENEEKIPKTKNMRKTSQLKWALGEKMAPEKVDFEDCKDVSDLRQ

SEQ ID NO: 2212 - protein, 56 aa, Influenza A virus
PVTVDGADGVKGFSYKYGNGVWIGRTKSNKLRKGFEMIWDPNGWTDTDNDFSVKQD

SEQ ID NO: 2213 - protein, 56 aa, Influenza A virus
DKTTIMAAFTGNAEGRTSDMRAEIIKMMESARPEEVSFQGRGVFEFSDERAANPIV

SEQ ID NO: 2214 - protein, 36 aa, Influenza A virus
FQNVHPITIGECPKYVKSTKLRMATGLRNVPSIQSR

SEQ ID NO: 2215 - protein, 56 aa, Influenza A virus
DMGNGCFKIYHKCDNACIGSIRNGTYDHDVYRDEALNNRFQIKGVELKSGYKDWIL

SEQ ID NO: 2216 - protein, 56 aa, Influenza A virus
TVQVDTIMEKNVTVTHAQDILEKTHNGKLCDLDGVKPLILRDCSVAGWLLGNPMCD

SEQ ID NO: 2217 - protein, 56 aa, Influenza A virus
STDTVDTVLEKNVTVTHSVNLLEDSHNGKLCRLKGIPPLQLGKCNIAGWLLGNPEC

SEQ ID NO: 2218 - protein, 56 aa, Influenza A virus
EKTRRQLRENAEDMGNGCFKIYHKCDNACIESIRNGTYDHDIYRDEALNNRFQIKG

SEQ ID NO: 2219 - protein, 34 aa, Influenza A virus
NIQRFAWGIHDENGGPSLPPKQKRYMAKRVESEV

SEQ ID NO: 2220 - protein, 56 aa, Influenza A virus
AGKDPKKTGGPIYKRVDGKWVRELVLYDKEEIRRIWRQANNGDDATAGLTHIMIWH

SEQ ID NO: 2221 - protein, 56 aa, Influenza A virus
NKKMEDGFLDVWTYNAELLVLMENERTLDFHDSNVKNLYDKVRMQLRDNAKELGNG

SEQ ID NO: 2222 - protein, 37 aa, Influenza A virus
FQNIHPVTIGECPKYVRSTKLRMVTGLRNIPSIQSRG

SEQ ID NO: 2223 - protein, 56 aa, Influenza A virus
KPFQNVNKITYGACPKYVKQNTLKLATGMRNVPEKQTRGIFGAIAGFIENGWEGMI

SEQ ID NO: 2224 - protein, 56 aa, Influenza A virus
EKTRKQLRENAEDMGNGCFKIYHKCDNACIGSIRNGTYDHDVYRDEALNNRFQIKG

SEQ ID NO: 2225 - protein, 56 aa, Influenza A virus
DLFVERSKAFSNCYPYDVPDYASLRSLVASSGTLEFITENFNWTGVTQKGGSNSCK

SEQ ID NO: 2226 - protein, 56 aa, Influenza A virus
NKKMEDGFLDVWTYNAELLVLMENERTLDFHDSNVKNLYDKVRMQLRDNAKEIGNG

SEQ ID NO: 2227 - protein, 56 aa, Influenza A virus
TNPLIRHENRMVLASTTAKAMEQMAGSSEQAAEAMEVASQARQMVHAMRTIGTHPS

SEQ ID NO: 2228 - protein, 56 aa, Influenza A virus
KEEIRRIWRQANNGDDATAGLTHMMIWHSNLNDTTYQRTRALVRTGMDPRMCSLMQ

SEQ ID NO: 2229 - protein, 56 aa, Influenza A virus
DAPFLDRLRRDQKSLKGRGSTLGLNIETATCVGKQIVERILKEESDEAFKMTMASA

SEQ ID NO: 2230 - protein, 56 aa, Influenza A virus
IRHENRMVLASTTAKAMEQMAGSSEQAAEAMEVANQTRQMVHAMRTIGTHPSSSAG

SEQ ID NO: 2231 - protein, 56 aa, Influenza A virus
KELGNGCFEFYHKCDDECMESVKNGTYDYPQYSEEARLNREEISGVKLESMGTYQI

SEQ ID NO: 2232 - protein, 56 aa, Influenza A virus
TEQVDTIMEKNVTVTHAQDILEKTHNGKLSDLDGVKPLILRDCSVAGWLLGNPMCD

SEQ ID NO: 2233 - protein, 29 aa, Influenza A virus
SSISFCGVNSDTVAWSWPDGAELPFTIDK

SEQ ID NO: 2234 - protein, 56 aa, Influenza A virus
ELGNGCFEFYHKCDNECMESVRNGTYDYPQYSEEARLKREEISGVKLESIGTYQIL

SEQ ID NO: 2235 - protein, 56 aa, Influenza A virus
MSLLTEVETYVLSIVPSGPLKAEIAQRLEDVFAGKNTDLQALMEWLKTRPILSPLT

SEQ ID NO: 2236 - protein, 56 aa, Influenza A virus
YPRYPGVRCVCRDNWKGSNRPVVDINVKDYSIVSSYVCSGLVGDTPRKNDRSSSSY

SEQ ID NO: 2237 - protein, 56 aa, Influenza A virus
ENERTLDFHDSNVKNLYDKVRLQLRDNAKELGNGCFEFYHKCDNECMESVRNGTYD

SEQ ID NO: 2238 - protein, 56 aa, Influenza A virus
DFHDSNVKNLYDKVRMQLRDNAKEIGNGCFEFYHKCDDECMNSVRNGTYDYPKYEE

SEQ ID NO: 2239 - protein, 34 aa, Influenza A virus
NIQRFAWGIRDEDGGPPLPPKQKRYMARRIESEV

SEQ ID NO: 2240 - protein, 56 aa, Influenza A virus
AIVSLVKSDQICIGYHANNSTEQVDTIMEKNVTVTHAQDILEKTHNGKLCDLDGVK

SEQ ID NO: 2241 - protein, 56 aa, Influenza A virus
MEQEQDTPWTQSTEHINIQKKGSGQQTQRLGRPNSTQLMDHYLRIMSQADMHKQTV

SEQ ID NO: 2242 - protein, 56 aa, Influenza A virus
FQNVHPVTIGECPKYVKSTKLRMVTGLRNIPSIQSRGLFGAIAGFIEGGWTGMIDG

SEQ ID NO: 2243 - protein, 56 aa, Influenza A virus
NRLRKGFEMIWDPNGWTDTDSDFSVKQDVVAITDWSGYSGSFVQHPELTGLDCIRP

SEQ ID NO: 2244 - protein, 56 aa, Influenza A virus
QDLPGNDNSTATLCLGHHAVPNGTIVKTITDDQIEVTNATELVQSSSTGKICNNPH

SEQ ID NO: 2245 - protein, 56 aa, Influenza A virus
DKPTIMAAFTGNTEGRTSDMRAEIIRMMEGAKPEEMSFQGRGVFELSDERAANPIV

SEQ ID NO: 2246 - protein, 56 aa, Influenza A virus
PVNVDGADGIKGFSYRYGNGVWIGRTKSNSSRKGFEMIWDPNGWTDTDSNFLVKQD

SEQ ID NO: 2247 - protein, 56 aa, Influenza A virus
DTICVGYHANNSTDTVDTILEKNVTVTHSVNLLEDRHNGKLCSLNGIAPLQLGKCN

SEQ ID NO: 2248 - protein, 56 aa, Influenza A virus
EKTLENCETKCQTPLGAINTTLPFHNIHPLTIGECPKYVKSDRLVLATGLRNVPQI

SEQ ID NO: 2249 - protein, 50 aa, Influenza A virus
ESARPEEVSFQGRGVFELSDERATNPIVPSFDMSNEGSYFFGDNAEEYDN

SEQ ID NO: 2250 - protein, 56 aa, Influenza A virus
RTQESECACVNGSCFTVMTDGPSNGQASYKIFRIEKGKVVKSAELNAPNYHYEECS

SEQ ID NO: 2251 - protein, 47 aa, Influenza A virus
TPHGALNSSLPFQNVHPITIGECPKYVKSTKLRMATGLRNVPSIQSR

SEQ ID NO: 2252 - protein, 56 aa, Influenza A virus
STDTVDTVLEKNVTVTHSVNLLEDSHNGKLCSLNGIAPLQLGKCNVAGWLLGNPEC

SEQ ID NO: 2253 - protein, 56 aa, Influenza A virus
LRVSSFIRGKKVVPRGKLSTRGVQIASNENVEAMDSSTLELRSRYWAIRTRSGGNT

SEQ ID NO: 2254 - protein, 56 aa, Influenza A virus
ERTLDFHDSNVRNLYEKVKSQLRNNAKEIGNGCFEFYHKCDDECMESVKNGTYDYP

SEQ ID NO: 2255 - protein, 56 aa, Influenza A virus
ERATIMAAFTGNTEGRTSDMRTEIIRMMENARPEDVSFQGRGVFELSDEKATNPIV

SEQ ID NO: 2256 - protein, 56 aa, Influenza A virus
STDTVDTVLEKNVTVTHSVNLLEDRHNGKLCKLGGIAPLHLGKCNIAGRLLGNPEC

SEQ ID NO: 2257 - protein, 56 aa, Influenza A virus
DMGNGCFKIYHKCDNACIESIRNGTYDHDVYRDEALNNRFQIKGVELKSGYKDWIL

SEQ ID NO: 2258 - protein, 56 aa, Influenza A virus
FQNIHPVTIGECPKYVKSTKLRMATGLRNVPSIQSRGLFGAIAGFIEGGWTGMIDG

SEQ ID NO: 2259 - protein, 48 aa, Influenza A virus
DKPTIMAAFTGNAEGRTSDMRAEIIRMMEGAKPEEVSFQGRGVFELSD

SEQ ID NO: 2260 - protein, 56 aa, Influenza A virus
TNSRSGFEMIWDPNGWTGTDSSFSVKQDIVAITDWSGYSGSFVQHPELTGLDCIRP

SEQ ID NO: 2261 - protein, 56 aa, Influenza A virus
GIITSNASMDECDTKCQTPQGAINSSLPFQNIHPVTIGECPKYVRSTKLRMVTGLR

SEQ ID NO: 2262 - protein, 56 aa, Influenza A virus
APRGYFKMRTGKSSIMRSDAPIDTCISECITPNGNIPNDKPFQNVNKITYGACPKY

SEQ ID NO: 2263 - protein, 56 aa, Influenza A virus
MEQEQDTPWTQLTEHINIQKKGNGQQTQRLGRPNLTQLMDHYLRIMSQADMHKQTV

SEQ ID NO: 2264 - protein, 56 aa, Influenza A virus
DKSTIMAAFTGNTEGRTSDMRAEIIRMMEGAKPEEVSFRGRGVFELSDEKATNPIV

SEQ ID NO: 2265 - protein, 56 aa, Influenza A virus
GGNTNQQRASAGQISVQPAFSVQRNLPFDKPTIMAAFTGNTEGRTSDMRTEIIRMM

SEQ ID NO: 2266 - protein, 56 aa, Influenza A virus
STDTVDTVLEKNVTVTHSVNLLEDRHNGKLCKLRGVAPLHLGKCNIAGWLLGNPEC

SEQ ID NO: 2267 - protein, 56 aa, Influenza A virus
TEGKLENCETKCQTPLGAINTTLPFHNIHPLTIGECPKYVKSERLVLATGLRNVPQ

SEQ ID NO: 2268 - protein, 56 aa, Influenza A virus
GIIISDTPVHDCNTTCQTPKGAINTSLPFQNIHPVTIGECPKYVKSTKLRMATGLR

SEQ ID NO: 2269 - protein, 56 aa, Influenza A virus
IASNENMEVIDSNTLELRSKYWAIRTKSGGNTSQQKASAGQISVQPTFSVQRNLPF

SEQ ID NO: 2270 - protein, 56 aa, Influenza A virus
RRIENLNKQMEDGFLDVWTYNAELLVLMENERTLDFHDSNVKNLYDKVRLQLRDNA

SEQ ID NO: 2271 - protein, 56 aa, Influenza A virus
QLKWALGEKMAPEKVDFEDCKDVSDLRQYDSDEPQPRSLASWIQSEFNKACELTDS

SEQ ID NO: 2272 - protein, 56 aa, Influenza A virus
EVAFAVVCATCEQIADSQHRSHRQMVTTTNPLIRHENRMVLASTTAKAMEQMAGSS

SEQ ID NO: 2273 - protein, 56 aa, Influenza A virus
QNSLTIERMVLSAFDERRNKYLEEHPSAGKDPKKTGGPIYKRVDGKWVRELVLYDK

SEQ ID NO: 2274 - protein, 56 aa, Influenza A virus
TNSRSGFEMIWDPNGWTGTDSNFSLKQDIVAMTDWSGYSGSFVQHPEMSGLDCIRP

SEQ ID NO: 2275 - protein, 56 aa, Influenza A virus
RNIPSIQSRGLFGAIAGFIEGGWTGMIDGWYRYHHQNEQGSGYAADQKSTQNAING

SEQ ID NO: 2276 - protein, 56 aa, Influenza A virus
NDKHSNGTVKDRSPYRTLMSCPVGEAPSPYNSRFESVAWSASACHDGTSWLTIGIS

SEQ ID NO: 2277 - protein, 56 aa, Influenza A virus
KEEIRRVWRQANNGEDATAGLTHIMIWHSNLNDATYQRTRALVRTGMDPRMCSLMQ

SEQ ID NO: 2278 - protein, 56 aa, Influenza A virus
ERATIMAAFTGNTEGRISDMRTEIIRMMESARPEDVSFQGRGVFELSDEKATNPIV

SEQ ID NO: 2279 - protein, 56 aa, Influenza A virus
VKRGINDRNFWRGENGRRTRIAYERMCNILKGKFQTAAQRAMMDQVRESRNPGNAE

SEQ ID NO: 2280 - protein, 56 aa, Influenza A virus
GGNTNQQRASAGQISVQPAFSVQKNLPFDKSTIMAAFTGNTEGRTSDMRAEIIRMM

SEQ ID NO: 2281 - protein, 50 aa, Influenza A virus
EGAKPEEVSFRGRGVFELSDEKATNPIVPSFDMSNEGSYFFGDNAEEYDN

SEQ ID NO: 2282 - protein, 56 aa, Influenza A virus
FQNIHPITIGKCPKYVKSTKLRLATGLRNVPSIQSRGLFGAIAGFIEGGWTGMVDG

SEQ ID NO: 2283 - protein, 56 aa, Influenza A virus
IKRGINDRNFWRGENGRKTRGAYERMCNILKGKFQTAAQRAMMDQVRESRNPGNAE

SEQ ID NO: 2284 - protein, 56 aa, Influenza A virus
DAPFLDRLRRDQKSLKGRSSTLGLDIESSTRAGRQIVKRILKEESDSEPKGTIAPV

SEQ ID NO: 2285 - protein, 56 aa, Influenza A virus
IINSNAPMDKCDAKCQTPQGAINSSLPFQNVHPVTIGECPKYVRSAKLRMVTGLRN

SEQ ID NO: 2286 - protein, 56 aa, Influenza A virus
DKTTIMAAFTGNAEGRTSDMRAEIIRMMESAKPEEVSFQGRGVFELSDEKAPNPIV

SEQ ID NO: 2287 - protein, 56 aa, Influenza A virus
GIITSNASIDECDAKCQTPQGAINSSLPFQNVHPVTIGECPKYVRSTKLRMVTGLR

SEQ ID NO: 2288 - protein, 56 aa, Influenza A virus
GIITSDAPVHNCDTKCQTPYGALNSSLPFQNVHPITIGECPKYVKSTKLRMATGLR

SEQ ID NO: 2289 - protein, 56 aa, Influenza A virus
DKTTIMAAFTGNAEGRTSDMRAEIIKMMESARPEEVSFQGRGVFELSDERATNPIV

SEQ ID NO: 2290 - protein, 56 aa, Influenza A virus
EKTRRQLRENAEDMGNGCFKIYHKCDNACIGSIRNGTYDHDVYRDEALNNRFQIKG

SEQ ID NO: 2291 - protein, 31 aa, Influenza A virus
MLKDEPSNRGRNVRSLYRSVRPPQSRDRTET

SEQ ID NO: 2292 - protein, 56 aa, Influenza A virus
GGNTNQQRASAGQISVQPTFSVQRNLPFDKTTIMAAFTGNAEGRTSDMRAEIIRMM

SEQ ID NO: 2293 - protein, 50 aa, Influenza A virus
ESSRPEDVSFQGRGVFELSDEKATNPIVPSFDMSNEGSYFFGDNAEEYDN

SEQ ID NO: 2294 - protein, 56 aa, Influenza A virus
IAPEYAYKIVKKGDSAIMKSELEYGNCNTKCQTPMGAINSSMPFHNIHPLTIGECP

SEQ ID NO: 2295 - protein, 56 aa, Influenza A virus
KIQWSQDPTMLYNKMEFEPFQSLVPRATRGQYSGFVRTLFQQMRDVLGTFDTAQII

SEQ ID NO: 2296 - protein, 56 aa, Influenza A virus
AGKDPKKTGGPIYKRVDGKWMRELVLYDKEEMRRIWRQANNGDDATAGLTHLMIWH

SEQ ID NO: 2297 - protein, 56 aa, Influenza A virus
PVTVDGADGVKGFSYRYGNGVWIGRTKSNSSRKGFEMIWDPNGWTDTDSNFLVKQD

SEQ ID NO: 2298 - protein, 56 aa, Influenza A virus
TEVETYVLSIIPSGPLKAEIAQRLESVFAGKNTDLEALMEWLKTRPILSPLTKGIL

SEQ ID NO: 2299 - protein, 56 aa, Influenza A virus
NRLRKGFEMIWDPNGWTNTDSDFSVKQDVVAITDWSGYSGSFVQHPELTGLDCIRP

SEQ ID NO: 2300 - protein, 56 aa, Influenza A virus
TIGEELRSGYETFKVIGGWSTPNSKLQINRQVIVDSDNRSGYSGIFSVEGKSCINR

SEQ ID NO: 2301 - protein, 31 aa, Influenza A virus
GDVVLVMKRKRNSSILTDSQTATKRIRMAIN

SEQ ID NO: 2302 - protein, 56 aa, Influenza A virus
EAAFGLICATCEQIADSQHRSHRQMVTTTNPLIRHENRMVLASTTAKAMEQMAGSS

SEQ ID NO: 2303 - protein, 56 aa, Influenza A virus
PYLGKSSFFRNVVWLIKKNSTYPTIKRSYNNTNQEDLLVLWGIHHPNDAAEQTKLY

SEQ ID NO: 2304 - protein, 56 aa, Influenza A virus
KPGDVLMINSNGNLIAPRGYFKIRAGKSSIMRSDAPIDTCVSECITPNGSIPNDKP

SEQ ID NO: 2305 - protein, 56 aa, Influenza A virus
IKRGINDRNFWRGENGRRTRIAYERMCNILKGKFQTAAQKAMMDQVRESRNPGNAE

SEQ ID NO: 2306 - protein, 56 aa, Influenza A virus
RTQESECACVNGSCFTVMTDGPSNGQASYKIFKIEKGKVVKSVELNAPNYHYEECS

SEQ ID NO: 2307 - protein, 56 aa, Influenza A virus
NGNGDPNNMDRAVKLYRKLKREITFHGAKEIALSYSAGALASCMGLIYNRMGAVTT

SEQ ID NO: 2308 - protein, 56 aa, Influenza A virus
NFESTGNLIAPEYGFKISKRGSSGIMKTEKTLENCETKCQTPLGAINTTLPFHNIH

SEQ ID NO: 2309 - protein, 56 aa, Influenza A virus
GGNTNQQRASAGQISIQPTFSVQRNLPFDKTTIMAAFTGNAEGRTSDMRAEIIRMM

SEQ ID NO: 2310 - protein, 33 aa, Influenza A virus
NSEGTGQAADLKSTQAAIDQINGKLNRVIEKTN

SEQ ID NO: 2311 - protein, 56 aa, Influenza A virus
LLTEVETYVLSIIPSGPLKAEIAQKLEDVFAGKNTDLEALMEWLKTRPILSPLTKG

SEQ ID NO: 2312 - protein, 56 aa, Influenza A virus
MGQEQDIPWILSTGHISTQKGENGQQTPKLEHHNSTRLMGHCQKTMNRVVMPKQIV

SEQ ID NO: 2313 - protein, 56 aa, Influenza A virus
IKRGINDRNFWRGENGRRTRIAYERMCNILKGKFQTAAQRAMVDQVRESRNPGNAE

SEQ ID NO: 2314 - protein, 56 aa, Influenza A virus; identical to SEQ ID NO: 2306

SEQ ID NO: 2315 - protein, 56 aa, Influenza A virus
ENSTWVNQTYVNINNTNVVAGKDTTSVTLAGNSSLCPIRGWAIYSKDNSIRIGSKG

SEQ ID NO: 2316 - protein, 50 aa, Influenza A virus
ENARPEDVSFQGRGVFELSDEKATNPIVPSFDMSNEGSYFFGDNAEEYEN

SEQ ID NO: 2317 - protein, 56 aa, Influenza A virus
GGNTNQQRASAGQISTQPTFSVQRNLPFDKATIMAAFTGNTEGRTSDMRAEIIKMM

SEQ ID NO: 2318 - protein, 56 aa, Influenza A virus
DAPFDDRLRRDQKALKGRGSTLGLDLRVATMEGKKIVEDILESETDENLKIAIASS

SEQ ID NO: 2319 - protein, 56 aa, Influenza A virus
MKSELEYGNCNTKCQTPMGAINSSMPFHNIHPLTIGECPKYVKSNRLVLATGLRNS

SEQ ID NO: 2320 - protein, 56 aa, Influenza A virus
TLDFHDSNVKNLYDKVRLQLRDNAKELGNGCFEFYHKCDNECMESVKNGTYDYPHY

SEQ ID NO: 2321 - protein, 56 aa, Influenza A virus
GDTIIFEANGNLIAPRFAFALSRGFGSGIITSNAPMDKCDAKCQTPQGAINSSLPF

SEQ ID NO: 2322 - protein, 56 aa, Influenza A virus
GYHHSNEQGSGYAADKESTQKAIDGVTNKVNSIIDKMNTQFEAVGREFNNLERRIE

SEQ ID NO: 2323 - protein, 56 aa, Influenza A virus
AFEDLRVSSFIRGKKVIPRGKLSTRGVQIASNENVETMDSNTLELRSRYWAIRTRS

SEQ ID NO: 2324 - protein, 56 aa, Influenza A virus
DTIMEKNVTVTHAQDILEKTHNGKLCDLDGVKPLILRDCSVAGWLLGNPMCDEFIN

SEQ ID NO: 2325 - protein, 56 aa, Influenza A virus
PFQNVNKITYGACPKYIKQSTLKLATGMRNVPEKQTRGLFGAIAGFIENGWEGMID

SEQ ID NO: 2326 - protein, 34 aa, Influenza A virus
SIQRFAWGVRDENGGPSFPPKQKRYMARRVESEV

SEQ ID NO: 2327 - protein, 56 aa, Influenza A virus
PVNVDGADGVKGFSYRYGNGVWIGRTKSNSSRKGFEMIWDPNGWTDTDSNFLVKQD

SEQ ID NO: 2328 - protein, 56 aa, Influenza A virus
VKPGDILLINSTGNLIAPRGYFKIRNGKSSIMRSDAPIGTCSSECITPNGSIPNDK

SEQ ID NO: 2329 - protein, 56 aa, Influenza A virus
SNEQGSGYAADKESTQKAIDGVTNKVNSIIDKMNTQFEAVGREFNNLERRIENLNK

SEQ ID NO: 2330 - protein, 56 aa, Influenza A virus
RTIGKCPRYVKQKSLMLATGMKNVPEAPAHKQLTHHMRKKRGLFGAIAGFIENGWE

SEQ ID NO: 2331 - protein, 56 aa, Influenza A virus
SNALLKHRFEIIEGRDRNMAWTVVNSICNTTGIGKPRYLPDLYDYKEDRFIEIGVT

SEQ ID NO: 2332 - protein, 56 aa, Influenza A virus
CIGYHANNSTDTVDTVLEKNVTVTHSVNLLEDSHNGKLCRLKGIAPLQLGKCSIAG

SEQ ID NO: 2333 - protein, 56 aa, Influenza A virus
DMGNGCFKIYHKCDNACIESIRNGTYDHDIYRDEALNNRFQIKGCGVKSGYKDWIL

SEQ ID NO: 2334 - protein, 56 aa, Influenza A virus
KEEIRRIWRQANNGEDATAGLTHMMIWHSNLNDTTYQRTRALVRTGMDPRMCSLMQ

SEQ ID NO: 2335 - protein, 56 aa, Influenza A virus
GIITSNASMHECNTKCQTPQGAINSSLPFQNIHPVTIGECPKYVRSAKLRMVTGLR

SEQ ID NO: 2336 - protein, 56 aa, Influenza A virus
PGDKITFEATGNLVVPRYAFAMERNAGSGIIISDTPVHDCNTTCQTPKGAINTSLP

SEQ ID NO: 2337 - protein, 29 aa, Influenza A virus
SSISFCGVNSDTVGWSWPDGAELPFTIDK

SEQ ID NO: 2338 - protein, 56 aa, Influenza A virus
TNSRSGFEMIWDPNGWTGTDSNFSVKQDIVAITDWSGYSGSFVQHPELTGVDCIRP

SEQ ID NO: 2339 - protein, 56 aa, Influenza A virus
MSLLTEVETYVLSIVPSGPLKAEIAQRLEDVFAGKNTDLEALMEWLKTRPILSPLT

SEQ ID NO: 2340 - protein, 56 aa, Influenza A virus
YPVQNVTMPNNDNSDKLYIWGVHHPSTDKEQTDLYVQASGKVTVSTKRSQQTIIPN

SEQ ID NO: 2341 - protein, 56 aa, Influenza A virus
YKIFKIEKGKVVKSVELNAPNYHYEECSCYPDAGEITCVCRDNWHGSNRPWVSFNQ

SEQ ID NO: 2342 - protein, 56 aa, Influenza A virus
YPRYPGVRCICRDNWKGSNRPVVDINVKDYSIDSSYVCSGLVGDTPRNNDRSSSSY

SEQ ID NO: 2343 - protein, 56 aa, Influenza A virus
INFESTGNLIAPEYGFKISKRGSSGIMKTEGKLENCETKCQTPLGAINTTLPFHNI

SEQ ID NO: 2344 - protein, 56 aa, Influenza A virus
NIPSIQSRGLFGAIAGFIEGGWTGMIDGWYGYHHQNGQGSGYAADQKSTQNAIDGI

SEQ ID NO: 2345 - protein, 30 aa, Influenza A virus
GSSISFCGVNSDTVGWSWPDGAELPFTIDK

SEQ ID NO: 2346 - protein, 50 aa, Influenza A virus
ESAKPEEVSFQGRGVFELSDEKAPNPIVPSFDMSNEGSYFFGDNAEEYDN

SEQ ID NO: 2347 - protein, 56 aa, Influenza A virus
IASNENMDNMGSSTLELRSMYWAIRTRSGGNTNQQRASAGQISVQPTFSVQRNLPF

SEQ ID NO: 2348 - protein, 56 aa, Influenza A virus
GIITSNAPVHDCDTKCQTPHGAINSSLPFQNVHPVTIGECPKYVKSTKLRMVTGLR

SEQ ID NO: 2349 - protein, 56 aa, Influenza A virus
IGNGCFEFYHKCDDTCMESVKNGTYDYPKYSEESKLNREEIDGVKLESTRVYQILA

SEQ ID NO: 2350 - protein, 56 aa, Influenza A virus
KEEIRRIWRQANNGEDATAGLTHLMIWHSNLNDATYQRTRALVRTGMDPRMCSLMQ

SEQ ID NO: 2351 - protein, 56 aa, Influenza A virus
VKRGINDRNFWRGENGRKTRSAYERMCNILKGKFQTAAQRAMVDQVRESRNPGNAE

SEQ ID NO: 2352 - protein, 39 aa, Influenza A virus
PKENTIWTSGSSISFCGVNSDTVGWSWPDGAELPFTIDK

SEQ ID NO: 2353 - protein, 56 aa, Influenza A virus
IKRGINDRNFWRGENGRRTRIAYERMCNILKGKFQTAAQRAMMDQVRESRNPGNAE

SEQ ID NO: 2354 - protein, 56 aa, Influenza A virus
IKRGINDRNFWRGENGRKTRIAYERMCNILKGKFQTAAQRAMMDQVRESRNPGNAE

SEQ ID NO: 2355 - protein, 56 aa, Influenza A virus
MRSDAPIGTCSSECITPNGSIPNDKPFQNVNRITYGACPRYVKQNTLKLATGMRNV

SEQ ID NO: 2356 - protein, 56 aa, Influenza A virus
GIITSDTPVHNCDTKCQTPHGALNSSLPFQNVHPITIGECPKYVKSTKLRMATGLR

SEQ ID NO: 2357 - protein, 56 aa, Influenza A virus
GGNTNQQRASAGQISVQPTFSVQRNLPFDKSTIMAAFTGNTEGRTSDMRAEIIRMM

SEQ ID NO: 2358 - protein, 56 aa, Influenza A virus
GNGCFEFYHKCNNECMESVKNGTYDYPKYSEESKLNREKIDGVKLESMGVYQILAI

SEQ ID NO: 2359 - protein, 56 aa, Influenza A virus
IASNENMETMESSTLELRSRYWAIRTKSGGNTNQQRASAGQISIQPTFSVQRNLPF

SEQ ID NO: 2360 - protein, 50 aa, Influenza A virus
ESARPEEVSFQGRGVFEFSDERAANPIVPSFDMSNEGSYFFGDNAEEYDN

SEQ ID NO: 2361 - protein, 56 aa, Influenza A virus
DMGNGCFKIYHKCDNACIESIRNGTYDHDIYRDEALNNRFQIKGVELKSGYKDWIL

SEQ ID NO: 2362 - protein, 56 aa, Influenza A virus
ERTLDFHDFNVRNLYEKVKSQLRNNAKEIGNGCFEFYHKCDDECMESVKNGTYNYP

SEQ ID NO: 2363 - protein, 56 aa, Influenza A virus
ENQHTIDLTDSEMNKLFEKTRRQLRENAEDMGNGCFKIYHKCDNACIGSIRNGTYD

SEQ ID NO: 2364 - protein, 37 aa, Influenza A virus
FQNVHPVTIGECPKYVRSTKLRMVTGLRNIPSIQSRG

SEQ ID NO: 2365 - protein, 56 aa, Influenza A virus
GGNTNQQRASAGQISIQPTFSVQRNLPFDKTTIMAAFTGNAEGRTSDMRAEIIKMM

SEQ ID NO: 2366 - protein, 56 aa, Influenza A virus
IGNGCFEFYHKCDDACMESVRNGTYDYPKYSEESKLNREEIDGVKLESMGVYQILA

SEQ ID NO: 2367 - protein, 56 aa, Influenza A virus
YPRYPGVRCVCRDNWKGSNRPVVDINVKDYSIASSYVCSGLVGDTPRKNDRYSSSY

SEQ ID NO: 2368 - protein, 56 aa, Influenza A virus
KEEIRRIWRQANNGEDATAGLTHMMIWHSNLNDATYQRTRALVRTGMDPRMCSLMQ

SEQ ID NO: 2369 - protein, 56 aa, Influenza A virus
KIQWSQNPTMLYNKMEFEPFQSLVPKAIRGQYSGFVRTLFQQMRDVLGTFDTAQII

SEQ ID NO: 2370 - protein, 56 aa, Influenza A virus
DYSIASSYVCSGLVGDTPRKNDRYSSSYCRNPNNEKGNHGVKGWAFDDGNDVWMGR

SEQ ID NO: 2371 - protein, 56 aa, Influenza A virus
EFYHKCDNECMESVRNGTYDYPQYSEEARLKREEISGVKLESIGTYQILSIYSTVA

SEQ ID NO: 2372 - protein, 56 aa, Influenza A virus
LEYGNCNTKCQTPMGAINSSMPFHNIHPLTIGECPKYVKSNRLVLATGLRNSPQRE

SEQ ID NO: 2373 - protein, 56 aa, Influenza A virus
PFQNVHPVTIGECPKYVRSTKLRMVTGLRNIPSIQSRGLFGAIAGFIEGGWTGMID

SEQ ID NO: 2374 - protein, 56 aa, Influenza A virus
IASNENVETMDSNTLELRSRYWAIRTRSGGNTNQQKASAGQISVQPTFSVQRNLPF

SEQ ID NO: 2375 - protein, 56 aa, Influenza A virus
ERATVMAAFVGNTEGRTSDMRTEIIRMMESAKPEDLSFQGRGVFELSDEKATNPIV

SEQ ID NO: 2376 - protein, 56 aa, Influenza A virus
IASNENMEAIDSNTLELRSRYWAIRTRSGGNTNQQRASAGQISVQPTFSVQRNLPF

SEQ ID NO: 2377 - protein, 56 aa, Influenza A virus
IASNENMETMDSSTLELRSRYWAIRTRSGGNTNQQKASAGQISVQPTFSVQRNLPF

SEQ ID NO: 2378 - protein, 56 aa, Influenza A virus
LDRLRRDQKSLRGRGNTLGLDIETATRAGKQIVERILEEESDEALKMPASRYLTDM

SEQ ID NO: 2379 - protein, 56 aa, Influenza A virus
IASNENVEAMDSSTLELRSRYWAIRTRSGGNTNQQKASAGQISVQPTFSVQRNLPF

SEQ ID NO: 2380 - protein, 56 aa, Influenza A virus
NSIRIGSKGDVFVIREPFISCSHLECRTFFLTQGALLNDKHSNGTVKDRSPYRTLM

SEQ ID NO: 2381 - protein, 56 aa, Influenza A virus
PGDTITFEATGNLVAPRYAFALNRGSGSGIITSNAPVHDCDTKCQTPHGAINSSLP

SEQ ID NO: 2382 - protein, 56 aa, Influenza A virus
VRKRFADQELGDAPFLDRLRRDQKSLRGRGNTLGLDIETATRAGKQIVERILEEES

SEQ ID NO: 2383 - protein, 56 aa, Influenza A virus
NLNKKMEDGFLDVWTYNAELLVLMENERTLDFHDSNVKNLYDKVRLQLRDNAKELG

SEQ ID NO: 2384 - protein, 56 aa, Influenza A virus
IGNGCFEFYHKCDNTCMESVKNGTYDYPKYSEEAKLNREEIDGVKLESTRIYQILA

SEQ ID NO: 2385 - protein, 56 aa, Influenza A virus
ERTLDYHDSNVKNLYEKVRSQLKNNAKEIGNGCFEFYHKCDNTCMESVKNGTYDYP

SEQ ID NO: 2386 - protein, 56 aa, Influenza A virus
IKRGINDRNFWRGENGRRTRVAYERMCNILKGKFQTAAQRAMMDQVRESRNPGNAE

SEQ ID NO: 2387 - protein, 56 aa, Influenza A virus
TISDESRSGYETFKVIGGWSTPNSKLQINRQVIVDSDNRSGYSGIFSVEGKSCINR

SEQ ID NO: 2388 - protein, 56 aa, Influenza A virus
FESNGNFIAPEYAYKIVKKGDSAIMKSELEYGNCNTKCQTPMGAINSSMPFHNIHP

SEQ ID NO: 2389 - protein, 34 aa, Influenza A virus
TLQRFTWRSSNEDGRPPLPPKQKRKMARTIESEV

SEQ ID NO: 2390 - protein, 56 aa, Influenza A virus
ATRAGKQIVERILKEESDEALKMTMASVPASRYLTDMTLEEMSRDWSMLIPKQKVA

SEQ ID NO: 2391 - protein, 56 aa, Influenza A virus
IASNENMDTMESSTLELRSRYWAIRTRSGGNTNQQRASAGQISIQPTFSVQRNLPF

SEQ ID NO: 2392 - protein, 56 aa, Influenza A virus
TKKGSSYPKLSKSYVNNKGKEVLVLWGVHHPPTGTDQQSLYQNADAYVSVGSSKYN

SEQ ID NO: 2393 - protein, 56 aa, Influenza A virus
AIIKKYTSGRQEKNPSLRMKWMMAMKYPITADKRITEMIPERNEQGQTLWSKINDA

SEQ ID NO: 2394 - protein, 56 aa, Influenza A virus
YKIFKMEKGKVVKSVELNAPNYHYEECSCYPDAGEITCVCRDNWHGSNRPWVSFNQ

SEQ ID NO: 2395 - protein, 56 aa, Influenza A virus
AIIKKYTSGRQEKNPSLRMKWMMAMKYPITADKRITEMVPERNEQGQTLWSQMSDA

SEQ ID NO: 2396 - protein, 56 aa, Influenza A virus
DAPFLDRLRRDQKSLRGRGSTLGLNIEAATRVGKQIVERILKEESDEALKMTMASA

SEQ ID NO: 2397 - protein, 56 aa, Influenza A virus
DYSIVSSYVCSGLVGDTPRKNDSSSSSYCRNPNNEKGSHGVKGWAFDDGDDVWMGR

SEQ ID NO: 2398 - protein, 56 aa, Influenza A virus
AWKQVLAEIQDFEDEKKIPRVKNMKKTSPLKWALGENMAPEKVDFDDCKDVSDLKQ

SEQ ID NO: 2399 - protein, 56 aa, Influenza A virus
DRSTIMAAFTGNTEGRTSDMRTEIIRLMESARPEDVSFQGRGVFELSDEKAASPIV

SEQ ID NO: 2400 - protein, 50 aa, Influenza A virus
ESARPEDVSFQGRGVFELSDEKAASPIVPSFDMSNEGSYFFGDNAEEYDN

SEQ ID NO: 2401 - protein, 50 aa, Influenza A virus
ESAKPEEVSFQGRGVFELSDEKAANPIVPSFDMSNEGSYFFGDNAEEYDN

SEQ ID NO: 2402 - protein, 56 aa, Influenza A virus
IQNSLTIERMVLSAFDERRNKYLEEHPSAGKDPKKTGGPIYRRVNGKWMRELILYD

SEQ ID NO: 2403 - protein, 56 aa, Influenza A virus
PVTVDGADGVKGFSYKYGNGVWIGRTKSNRLRKGFEMIWDPNGWTDTDSDFSVKQD

SEQ ID NO: 2404 - protein, 56 aa, Influenza A virus
DESEQRALYQNVGTYVSVGTSTLNKRSSPEIATRPKVNGQGGRMEFSWTILDIWDT

SEQ ID NO: 2405 - protein, 56 aa, Influenza A virus
YPRYPGVRCVCRDNWKGSNRPIVDINVKDYSIVSSYVCSGLVGDTPRKNDRSSSSY

SEQ ID NO: 2406 - protein, 56 aa, Influenza A virus
DRTTVMAAFSGNTEGRTSDMRTEIIRMMESARPEDVSFQGRGVFELSDEKAASPIV

SEQ ID NO: 2407 - protein, 50 aa, Influenza A virus
CFWVELVRGRPRENTTIWTSGSSISFCGVNSDTANWSWPDGAELPFTIDK

SEQ ID NO: 2408 - protein, 56 aa, Influenza A virus
NVKNLYDKVRLQLRDNAKELGNGCFEFYHKCDNECMESVKNGTYDYPQYSEEARLN

SEQ ID NO: 2409 - protein, 56 aa, Influenza A virus
IASNENMETMESSTLELRSKYWAIRTRSGGNTNQQRASAGQISIQPTFSVQRNLPF

SEQ ID NO: 2410 - protein, 56 aa, Influenza A virus
DAPFLDRLRRDQKSLKGRGSTLGLNIETATCVGKQIVERILKEESDEALKMTMASA

SEQ ID NO: 2411 - protein, 56 aa, Influenza A virus
ERTLDFHDSNVRNLYEKVKSQLKNNAKEIGNGCFEFYHKCDDACMESVRNGTYDYP

SEQ ID NO: 2412 - protein, 56 aa, Influenza A virus
PGDTITFEATGNLVVPRYAFAMNRGSGSGIITSDAPVHDCNTKCQTPQGAINTSLP

SEQ ID NO: 2413 - protein, 56 aa, Influenza A virus
DFHDSNVKNLYDKVRMQLRDNAKELGNGCFEFYHKCDDECMNSVKNGTYDYSKYEE

SEQ ID NO: 2414 - protein, 56 aa, Influenza A virus
KEEIRRIWRHANNGDDATAGLTHMMIWHSNLNDATYQRTRALVRTGMDPRMCSLMQ

SEQ ID NO: 2415 - protein, 56 aa, Influenza A virus
DYSIVSSYVCSGLVGDTPRKNDRSSSSYCRNPNNEKGNHGVKGWAFDDGNDVWMGR

SEQ ID NO: 2416 - protein, 56 aa, Influenza A virus
NGNGDPNNMDRAVKLYKKLKREITFHGAKEVSLSYSTGALASCMGLIYNRMGTVTT

SEQ ID NO: 2417 - protein, 56 aa, Influenza A virus
VKPGDVLVINSNGNLIAPRGYFKMRTGKSSIMRSDAPIDTCVSECITPNGSIPNDK

SEQ ID NO: 2418 - protein, 56 aa, Influenza A virus
SNGTKVNTLTERGVEVVNATETVERRTIPRICTKGKKAIDLGQCGLLGIITGPPQC

SEQ ID NO: 2419 - protein, 41 aa, Influenza A virus
HGLKRGPSTEGVPESMREEYRTEQQNAVDADDSHFVNIELE

SEQ ID NO: 2420 - protein, 56 aa, Influenza A virus
PNHDSNKGVTAACPHAGAKSFYKNLIWLVKKGNSYPKLSKSYINDKGKEVLVLWGI

SEQ ID NO: 2421 - protein, 56 aa, Influenza A virus
IASNENMETMDSNTLELRSRYWAIRTRSGGSTNQQKSSAGQISVQPTFSVQRNLPF

SEQ ID NO: 2422 - protein, 56 aa, Influenza A virus
LQQIESMIEAESSVKEKDMTKEFFENNSETWPIGESPKGVEEGSIGKVCRTLLAKS

SEQ ID NO: 2423 - protein, 56 aa, Influenza A virus
IGNGCFEFYHKCDDACMESVRNGTYDYPKYSEESKLNREEIDGVKLESMMVYQILA

SEQ ID NO: 2424 - protein, 29 aa, Influenza A virus
SSISFCGVDSDTVGWSWPDGAELPFTIDK

SEQ ID NO: 2425 - protein, 56 aa, Influenza A virus
DVMESMDKGEMEIITHFQRKRRVRDNMTKKMVTQRTIGKKKQRLNKRSYLIRALTL

SEQ ID NO: 2426 - protein, 56 aa, Influenza A virus
IASNENMDTMESSTLELRSRYWAIRTRSGGNTNQQRASAGQISVQPTFSVQRNLPF

SEQ ID NO: 2427 - protein, 56 aa, Influenza A virus
PLDSNCGGNCFHSGGTIVSSLPFQNINSRTVGKVPRYVRQPSLLLATGMRNVPENP

SEQ ID NO: 2428 - protein, 56 aa, Influenza A virus
AFEDLRVSGFIRGKKVVPRGKLSTRGVQIASNENVEAMDSNTLELRSRYWAIRTRS

SEQ ID NO: 2429 - protein, 56 aa, Influenza A virus
ERATIMAAFTGNTEGRTSDMRTEIIRMMESARPEDVSFQGRGVFELSDEKATNPVV

SEQ ID NO: 2430 - protein, 56 aa, Influenza A virus
IASNENMETMDSSTLELRSKYWAIRTRSGGNTNQQRASAGQISVQPTFSVQRNLPF

SEQ ID NO: 2431 - protein, 34 aa, Influenza A virus
IWTSGSSISFCGVNSDTVGWSWPDGAELPFTIDK

SEQ ID NO: 2432 - protein, 56 aa, Influenza A virus
IVKPGDILVINSNGNLIAPRGYFKMRTGKSSIMRSDAPIGTCSSECITPNGSIPND

SEQ ID NO: 2433 - protein, 56 aa, Influenza A virus
IASNENMDTMVSSTLELRSRYWAIRTRSGGNTNQQRASAGQISIQPTFSVQRNLPF

SEQ ID NO: 2434 - protein, 56 aa, Influenza A virus
IASNENMDNMESSTLELRSRYWAIRTRSGGNTNQQRASAGQISVQPTFSVQRNLPF

SEQ ID NO: 2435 - protein, 50 aa, Influenza A virus
ESAKPDDVSFQGRGVFELSDEKATNPIVPSFDMSKEGSYFFGDNAEEFDN

SEQ ID NO: 2436 - protein, 56 aa, Influenza A virus
GGNTNQQRASAGQISVQPTFSVQRNLPFEKSTVMAAFTGNTEGRTSDMRAEIIRMM

SEQ ID NO: 2437 - protein, 56 aa, Influenza A virus
SIQTGNQNQVEPISNTNFLTEKAVASVTLAGNSSLCPIRGWAVHSKDNSIRIGSKG

SEQ ID NO: 2438 - protein, 56 aa, Influenza A virus
LIVNAPNHEGIQAGVNRFYRTCKLVGINMSKKKSYINRTGTFEFTSFFYRYGFVAN

SEQ ID NO: 2439 - protein, 56 aa, Influenza A virus
NVNRITYGACPRYVKQNTLKLATGMRNVPEKQTRGIFGAIAGFIENGWEGMVDGWY

SEQ ID NO: 2440 - protein, 56 aa, Influenza A virus
GDILLINSTGNLIAPRGYFKIRTGKSSIMRSDAPIGTCSSECITPNGSIPNDKPFQ

SEQ ID NO: 2441 - protein, 56 aa, Influenza A virus
GDTIIFEANGNLIAPWYAFALSRGFESGIITSNAPMNECDAKCQTPQGAINSSLPF

SEQ ID NO: 2442 - protein, 56 aa, Influenza A virus
INFESTGNLIAPEYGFKISKRGSSGIMKTEGTLENCETKCQTPLGAINTTLPFHNV

SEQ ID NO: 2443 - protein, 56 aa, Influenza A virus
EVETYVLSIIPSGPLKAEIAQRLESVFAGKNTDLEALMEWLKTRPILSPLTKGILG

SEQ ID NO: 2444 - protein, 56 aa, Influenza A virus
VKPGDILVINSNGNLIAPRGYFKMRTGKSSIMRSDAPIGTCSSECITPNGSIPNDK

SEQ ID NO: 2445 - protein, 56 aa, Influenza A virus
KEEVRRIWRQANNGEDATAGLTHLMIWHSNLNDATYQRTRALVRTGMDPRMCSLMQ

SEQ ID NO: 2446 - protein, 56 aa, Influenza A virus
DKTTIMAAFTGNAEGRTSDMRAEIIKMMESARPEEVSFQGRGVFELSDERAANPIV

SEQ ID NO: 2447 - protein, 56 aa, Influenza A virus
DKTTIMAAFTGNAEGRTSDMRAEIIRMMESARPEEVSFQGRGVFELSDERAANPIV

SEQ ID NO: 2448 - protein, 56 aa, Influenza A virus
IASNENVEAMDSNTLELRSRYWAIRTRSGGNTNQQRASAGQISVQPTFSVQRNLPF

SEQ ID NO: 2449 - protein, 41 aa, Influenza A virus
HGLKKGPSTGGIPESMREEYRQEQQSDVSVDNSHFVNIELE

SEQ ID NO: 2450 - protein, 50 aa, Influenza A virus
ENAKPEEVSFRGRGVFELSDEKATNPIVPSFDMSNEGSYFFGDNAEEYDN

SEQ ID NO: 2451 - protein, 39 aa, Influenza A virus
VKQNTLKLATGMRNVPEKQTRGIFGAIAGFIENGWEGMV

SEQ ID NO: 2452 - protein, 56 aa, Influenza A virus
NKLRKGFEMIWDPNGWTDTDNDFSVKQDVVAITDWSGYSGSFVQHPELTGLDCIRP

SEQ ID NO: 2453 - protein, 56 aa, Influenza A virus
TKKGTSYPKLSKSYTNNKGKEVLVLWGVHHPPTTSEQQTLYQNVDAYVSVGSSKYN

SEQ ID NO: 2454 - protein, 56 aa, Influenza A virus
INFESTGNLIAPEYGFKISKRGSSGIMKTEKTLENCETKCQTPLGAINTTLPFHNI

SEQ ID NO: 2455 - protein, 56 aa, Influenza A virus
DVMESMDKEEMEITTHFQRKRRIRDNMTKKMVTQRTIGKKKQRLNKKSYLIRALTL

SEQ ID NO: 2456 - protein, 29 aa, Influenza A virus
DVVLVMKRKRDSSILTDSQTATKRIRMAI

SEQ ID NO: 2457 - protein, 56 aa, Influenza A virus
ERTLDFHDSNVRNLYEKVKSQLRNNAKELGNGCFEFYHKCDDECMESVKNGTYDYP

SEQ ID NO: 2458 - protein, 56 aa, Influenza A virus
PNHETTKGVTAACPYAGASSFYRNLLWLVKKENSYPKLSKSYVNNKGKEVLVLWGV

SEQ ID NO: 2459 - protein, 56 aa, Influenza A virus
GGNTNQQRASAGQISTQPTFSVQRNLPFDKTTIMAAFTGNAEGRTSDMRAEIIKMM

SEQ ID NO: 2460 - protein, 56 aa, Influenza A virus
VKQNTLKLATGMRNVPEKQTRGIFGAIAGFIENGWEGMIDGWYGFRHQNSEGTGQA

SEQ ID NO: 2461 - protein, 56 aa, Influenza A virus
IASNENMDTMESSTLELRSKYWAIRTRSGGNTNQQRASAGQISVQPAFSVQRNLPF

SEQ ID NO: 2462 - protein, 56 aa, Influenza A virus
NVPSIQSRGLFGAIAGFIEGGWTGMIDGWYGYHHQNEQGSGYAADQKSTQIAIDGI

SEQ ID NO: 2463 - protein, 56 aa, Influenza A virus
GGNTNQQRASAGQISVQPTFSVQRNLPFEKSTVMAAFTGNTEGRTSDMRAEIIRLM

SEQ ID NO: 2464 - protein, 56 aa, Influenza A virus
IQNSLTIERMVLSAFDERRNRYLEEHPSAGKDPKKTGGPIYKRVGGRWMRELVLYD

SEQ ID NO: 2465 - protein, 56 aa, Influenza A virus
ISPRSRSGFEMLKIPNAGTDPNSRITERQEIVDSNNWSGYSGSFIDYWDESSECYN

SEQ ID NO: 2466 - protein, 56 aa, Influenza A virus
VKKENSYPKLSKSYVNNKGKEVLVLWGIHHPPTSTDQQSLYQNADAYVFVGSSKYN

SEQ ID NO: 2467 - protein, 56 aa, Influenza A virus
NPITGSPGAPGVKGFGFLDSSNTWLGRTISPRSRSGFEMLKIPNAGTDPNSRITER

SEQ ID NO: 2468 - protein, 56 aa, Influenza A virus
GGNTNQQRASAGQISVQPTFSVQRNLPFEKATIMAAFTGNTEGRTSDMRTEIIRMM

SEQ ID NO: 2469 - protein, 56 aa, Influenza A virus
IGNGCFEFYHKCDDECMESVKNGTYDYPKYSEESKLNREEIDGVKLESMGVYQILA

SEQ ID NO: 2470 - protein, 56 aa, Influenza A virus
IQNSITIERMVLSAFDERRNKYLEEHPSAGKDPKKTGGPIYKKRDGKWMRELILYD

SEQ ID NO: 2471 - protein, 56 aa, Influenza A virus
PGDILLINSTGNLIAPRGYFKIRTGKSSIMRSDAPIGTCSSECITPNGSIPNDKPF

SEQ ID NO: 2472 - protein, 56 aa, Influenza A virus
IASNENMDTMGSSTLELRSRYWAIRTRSGGNTNQQRASAGQISIQPTFSVQRNLPF

SEQ ID NO: 2473 - protein, 56 aa, Influenza A virus
ATRVGKQIVERILKEESDEALKMTMASAPASRYLTDMTIEESSRDWFMLIPKQKVE

SEQ ID NO: 2474 - protein, 56 aa, Influenza A virus
ERSTIMAAFTGNTEGRTSDMRTEIIRMMESARPEDVSFQGRGVFELSDEKATNPIV

SEQ ID NO: 2475 - protein, 56 aa, Influenza A virus
SNGIKVDTLTEKGIEVVNATETVEQKNIPKICSKGKQTIDLGQCGLLGTTIGPPQC

SEQ ID NO: 2476 - protein, 56 aa, Influenza A virus
ERTLDFHDSNVKNLYEKVKNQLRNNAKEIGNGCFEFYHKCDNECMESVKNGTYDYP

SEQ ID NO: 2477 - protein, 56 aa, Influenza A virus
IASNENMETMESSTLELRSRYWAIRTRSGGNTNQQRASAGQISIQPTFSVQRNLPF

SEQ ID NO: 2478 - protein, 56 aa, Influenza A virus
TEANGLYPSLSKSYVNDREKEVLVLWGVHHPSNIEDQRTLYRKENAYVSVVSSNYN

SEQ ID NO: 2479 - protein, 56 aa, Influenza A virus
IGNGCFEFYHKCNNECMESVKNGTYDYPKYSEESKLNREKIDGVKLESMGVYQILA

SEQ ID NO: 2480 - protein, 56 aa, Influenza A virus
IQNSLTIERMVLSAFDERRNRYLEEHPSAGKDPKKTGGPIYKRVDGKWMRELVLYD

SEQ ID NO: 2481 - protein, 56 aa, Influenza A virus
PGDTIIFEANGNLIAPWHAFALNRGFGSGIITSNASMDECDTKCQTPQGAINSSLP

SEQ ID NO: 2482 - protein, 56 aa, Influenza A virus
RYWAIRTRSGGNTNQQRASAGQISVQPAFSVQRNLPFDKSTIMAAFTGNTEGRTSD

SEQ ID NO: 2483 - protein, 56 aa, Influenza A virus
ENVEAMDSSTLELRSRYWAIRTRSGGNTNQQKASAGQISVQPTFSVQRNLPFERAT

SEQ ID NO: 2484 - protein, 56 aa, Influenza A virus
DKPTIMAAFTGNTEGRTSDMRAEIIRMMEGAKPEEMSFQGRGVFELSDEKAANPIV

SEQ ID NO: 2485 - protein, 56 aa, Influenza A virus
IASNENMDAMESSTLELRSRYWAIRTRSGGNTNQQRASAGQISVQPAFSVQRNLPF

SEQ ID NO: 2486 - protein, 56 aa, Influenza A virus
YDKNATASFIYDGRLVDSIGSWSQNILRTQESECVCINGTCTVVMTDGSASGRADT

SEQ ID NO: 2487 - protein, 56 aa, Influenza A virus
YPRYPGVRCICRDNWKGSNRPVVDINVKDYSIDSSYVCSGLVGDTPRNNDRSSNSY

SEQ ID NO: 2488 - protein, 56 aa, Influenza A virus
IASNENMDTMGSSTLELRSRYWAIRTRSGGNTTQQRASAGQISVQPTFSVQRNLPF

SEQ ID NO: 2489 - protein, 56 aa, Influenza A virus
IASNENMEAMDSNTLELRSRYWAIRTRSGGNTNQQRASAGQISVQPTFSVQRNLPF

SEQ ID NO: 2490 - protein, 56 aa, Influenza A virus
ERATIMAAFTGNTEGRTSDMRTEIIRMMESARPEDVSFQGRGVFELSDEKATNPIV

SEQ ID NO: 2491 - protein, 56 aa, Influenza A virus
AFEDLRVSSFIRGTRVVPRGQLSTRGVQIASNENMDTMDSNTLELRSRYWAIRTRS

SEQ ID NO: 2492 - protein, 56 aa, Influenza A virus
RTQESECACVNGSCFTVMTDGPSNGQASYKIFRIEKGKIVKSVEMNAPNYHYEECS

SEQ ID NO: 2493 - protein, 56 aa, Influenza A virus
KEEIRRIWRQANNGEDATAGLTHLMIWHSNLNDSTYQRTRALVRTGMDPRMCSLMQ

SEQ ID NO: 2494 - protein, 50 aa, Influenza A virus
ESAKPEDLSFQGRGVFELSDEKATNPIVPSFDMNNEGSYFFGDNAEEYDN

SEQ ID NO: 2495 - protein, 56 aa, Influenza A virus
PITGSPGAPGIKGFGFLNEDNTWLGRTISPRLRSGFEMLKIPNAGTDPESKIKERQ

SEQ ID NO: 2496 - protein, 56 aa, Influenza A virus
NIPSIQSRGLFGAIAGFIEGGWTGMIDGWYGYHHQNEQGSGYAADQRSTQNAIDGI

SEQ ID NO: 2497 - protein, 56 aa, Influenza A virus
IASNENMDTMESSTLELRSRYWAIRTRSGGNTNQQRASAGQISVQPAFSVQRNLPF

SEQ ID NO: 2498 - protein, 56 aa, Influenza A virus
IGNGCFEFYHKCDNECMESVKNGTYDYPKYSEESKLNRAKIDGVKLESMGVYQILA

SEQ ID NO: 2499 - protein, 56 aa, Influenza A virus
RGKSMGIQSGVQVDANCEGDCYHSGGTIISNLPFQNINSRAVGKCPRYVKQESLLL

SEQ ID NO: 2500 - protein, 56 aa, Influenza A virus
IASNENMDTMGSSTLELRSRYWAIRTRSGGNTNQQRASAGQISVQPAFSVQRNLPF

SEQ ID NO: 2501 - protein, 50 aa, Influenza A virus
ENAKPEDLSFQGRGVFELSDEKATNPIVPSFDMNNEGSYFFGDNAEEYDN

SEQ ID NO: 2502 - protein, 56 aa, Influenza A virus
DKTTIMAAFTGNTEGRTSDMRAEIIRMMESARPEEVSFQGRGVFELSDERATNPIV

SEQ ID NO: 2503 - protein, 56 aa, Influenza A virus
IKRGINDRNFWRGENGRKTRIAYERMCNILKGKFQTAAQKAMMDQVRESRNPGNAE

SEQ ID NO: 2504 - protein, 56 aa, Influenza A virus
MSLLTEVETYVLSIVPSGPLKAEIAQRLEDVFAGKNTDLEVLMEWLKTRPILSPLT

SEQ ID NO: 2505 - protein, 56 aa, Influenza A virus
SNLNDATYQRTRALVRTGMDPRMCSLMQGSTLPRRSGAAGAAVKGVGTIAMELIRM

SEQ ID NO: 2506 - protein, 56 aa, Influenza A virus
HHSNDQGSGYAADKESTQKAFDGITNKVNSVIEKMNTQFEAVGKEFSNLEKRLENL

SEQ ID NO: 2507 - protein, 56 aa, Influenza A virus
EVAFGLVCATCEQIADSQHRSHRQMETTTNPLIRHENRMVLASTTAKAMEQMAGSS

SEQ ID NO: 2508 - protein, 56 aa, Influenza A virus
IASNENVEIMDSNTLELRSRYWAIRTRSGGNTNQQKASAGQISVQPTFSVQRNLPF

SEQ ID NO: 2509 - protein, 56 aa, Influenza A virus
IASNENVEAMDSSTLELRSRYWAIRTRSGGNTNQQKASADQISVQPTFSVQRNLPF

SEQ ID NO: 2510 - protein, 56 aa, Influenza A virus
PNNGKFDKLYIWGVHHPSTDSDQTSLYVQASGRVTVSTKRSQQTVTPNIGSRPWVR

SEQ ID NO: 2511 - protein, 56 aa, Influenza A virus
IASNENMDTMESSTLELRSRYWAIRTRSGGNTNQQRASAGQISVQPAFSVQKNLPF

SEQ ID NO: 2512 - protein, 56 aa, Influenza A virus
PYSHGTGTGYTMDTVNRTHQYSERGKWTTNTETGAPQLNPIDGPLPEDNEPTGYAQ

SEQ ID NO: 2513 - protein, 56 aa, Influenza A virus
MDSNTVSSFQVDCFLWHVRKRLADNGLGDAPFLDRLRRDQKSLKGRGSTLGLNIET

SEQ ID NO: 2514 - protein, 56 aa, Influenza A virus
RNVPEKQTRGLFGAIAGFIENGWEGMIDGWYGFRHQNSEGTGQAADLKSTQAAIDQ

SEQ ID NO: 2515 - protein, 56 aa, Influenza A virus
SNLNDATYQRTRALVRTGMDPRMCSLMQGSTLPRRSGAAGAAVKGVGTIAMELIGM

SEQ ID NO: 2516 - protein, 56 aa, Influenza A virus
IASNENMDTMGSSTLELRSRYWAIRTRSGGNTNQQRASAGQISVQPTFSVQRNLPF

SEQ ID NO: 2517 - protein, 56 aa, Influenza A virus
VKPGDVLVINSNGNLIAPRGYFKMRTGKSSIMRSDAPIDTCISECITPNGSIPNDK

SEQ ID NO: 2518 - protein, 56 aa, Influenza A virus
IASNENMETMDSSTLELRSRYRAIRTRSGGNTNQQRASAGQISVQPTFSVQRNLPF

SEQ ID NO: 2519 - protein, 56 aa, Influenza A virus; identical to SEQ ID NO: 2374

SEQ ID NO: 2520 - protein, 56 aa, Influenza A virus; identical to SEQ ID NO: 2323

SEQ ID NO: 2521 - protein, 56 aa, Influenza A virus
DKRYGPALSISELSNLAKGEKANVLIGQGDVVLVMKRKRDSSILTDSQTATKRIRM

SEQ ID NO: 2522 - protein, 56 aa, Influenza A virus
AIIKKYTSGRQEKNPALRMKWMMAMKYPITADKRIIETIPERNEQGQTLWSRTSDA

SEQ ID NO: 2523 - protein, 56 aa, Influenza A virus
KEEIRRIWRQANNGEDATSGLTHIMIWHSNLNDATYQRTRALVRTGMDPRMCSLMQ

SEQ ID NO: 2524 - protein, 56 aa, Influenza A virus
TISEKSRLGYETFKVIEGWSNPKSKLQINRQVIVDRGNRSGYSGIFSVEGKSCINR

SEQ ID NO: 2525 - protein, 56 aa, Influenza A virus
ESGDPNALLKHRFEIIEGRDRTMAWTVVNSICNTTGVEKPKFLPDLYDYKENRFIE

SEQ ID NO: 2526 - protein, 56 aa, Influenza A virus
DKATIMAAFSGNTEGRTSDMRAEIIKMMESARPEEVSFQGRGVFELSDERATNPIV

SEQ ID NO: 2527 - protein, 56 aa, Influenza A virus
DAPFLDRLRRDQKSLKGRGSTLGLNIETATLAGKQIVEWILKEESNETLKMTIASV

SEQ ID NO: 2528 - protein, 56 aa, Influenza A virus
PGDTIIFEANGNLIAPWHAFALSRGFGSGIITSNAPMDECDTKCQTPQGAINSSLP

SEQ ID NO: 2529 - protein, 56 aa, Influenza A virus
ATRVGKQIVERILKEESDEALKMTIASAPASRYLTDMTIEELSRDWFMLMPKQKVE

SEQ ID NO: 2530 - protein, 19 aa, Influenza A virus
AWRSSSENGRHPLTPKQKR

SEQ ID NO: 2531 - protein, 56 aa, Influenza A virus
FQNIHPVTIGECPKYVRSAKLRMVTGLRNIPSIQSRGLFGAIAGFIEGGWTGMIDG

SEQ ID NO: 2532 - protein, 56 aa, Influenza A virus
KVERLKQGTFGPVHFRNQVKIRRRVDINPGHADLSAKEAQDVIMEVVFPNEVGARI

SEQ ID NO: 2533 - protein, 56 aa, Influenza A virus
TFGPVHFRNRVKIRRRVDINPGHADLSSKEAQDVIMEVVFPNEVGARILTSESQLM

SEQ ID NO: 2534 - protein, 56 aa, Influenza A virus
AKRQLKKDLKSKGQCEGLLTKVSHQTSQVSTTLEPMWMDSSRMATLRASFPKCLEK

SEQ ID NO: 2535 - protein, 56 aa, Influenza A virus
YEELKHLLSSVKHFEKVKILPKDRWTQHTTTGGSQACAVSGNPSFFRNMVWLTEKE

SEQ ID NO: 2536 - protein, 56 aa, Influenza A virus
AWKQVLAELQDIENEEKIPKTKNMRKTSQLKWALGENMAPEKVDFEDCKDVSDLRQ

SEQ ID NO: 2537 - protein, 56 aa, Influenza A virus
KTSQLKWALGENMAPEKVDFDDCKDISDLKQYDSDEPELRSFSSWIQNEFNKACEL

SEQ ID NO: 2538 - protein, 56 aa, Influenza A virus
YLLSWKQVLEELQDIESEERIPRTKNMKKTSQLKWALGENMAPEKVDFDDCKDISD

SEQ ID NO: 2539 - protein, 41 aa, Influenza A virus
HGLKRGPSTEGVPESMREEYRKEQQSAVDADDSHFVNIELE

SEQ ID NO: 2540 - protein, 56 aa, Influenza A virus
QLKWALGENMAPEKVDFDDCKDISDLKQYDSDEPELRSLSSWIQNEFNKACELTDS

SEQ ID NO: 2541 - protein, 56 aa, Influenza A virus
FEKVERLKHGTFGPVHFRNQVKIRRRVDINPGHADLSAKEAQDVIMEVVFPNEVGA

SEQ ID NO: 2542 - protein, 56 aa, Influenza A virus
AWKQVLAELQDIENEEKIPKTKNMKKTGQLKWALGENMAPEKVDFEDCKDVSDLRQ

SEQ ID NO: 2543 - protein, 38 aa, Influenza A virus
SARPEEVSFQGRGVFELSDERATNPIVPSFDMSNEGSY

SEQ ID NO: 2544 - protein, 56 aa, Influenza A virus
MDSNTVSSFQVDCFLWHVRKQFADQELGDAPVRDRLRRDQKSLRGRGSTLGLDIET

SEQ ID NO: 2545 - protein, 56 aa, Influenza A virus
QIASNENMETIDSITLELRSKYWAIRTRSGGNTNKQRASAGQISVQPTFSVQRNLP

SEQ ID NO: 2546 - protein, 56 aa, Influenza A virus; identical to SEQ ID NO: 2276

SEQ ID NO: 2547 - protein, 56 aa, Influenza A virus
GDTIIFEANGNLIAPRYAFALSRGFGSGIINSNAPMDKCDAKCQTPQGAINSSLPF

SEQ ID NO: 2548 - protein, 34 aa, Influenza A virus
TLQRFAWRSSNENGGPPFTPTQKRKMAGTIRSEV

SEQ ID NO: 2549 - protein, 56 aa, Influenza A virus
FHDSNVKNLYDKVRMQLRDNAKEIGNGCFEFYHKCDDECMNSVRNGTYDYPKYEEE

SEQ ID NO: 2550 - protein, 56 aa, Influenza A virus
QQIESMIEAESSVKEKDMTKEFFENKSETWPIGESPKGVEEGSIGKVCRTLLAKSV

SEQ ID NO: 2551 - protein, 56 aa, Influenza A virus
IASNENMETMDSSTLELRSRYWAIRTRSGGNTNQQRASAGQISVQPTFSVQRNLPF

SEQ ID NO: 2552 - protein, 34 aa, Influenza A virus
SWKQWLSLKNPTQGFLKTRALKRWKSFNKQGWTN

SEQ ID NO: 2553 - protein, 56 aa, Influenza A virus
MDSNTVSSFQVDCFLWHVRKQVVDQELSDAPFLDRLRRDQRSLRGRGSTLGLDIKA

SEQ ID NO: 2554 - protein, 56 aa, Influenza A virus
SNGTKVNTLTERGVEVVNATETVERTNVPRICSKGKRTVDLGQCGLLGTITGPPQC

SEQ ID NO: 2555 - protein, 56 aa, Influenza A virus
LQQIESMIEAESSVKEKDMTKEFFENKSETWPIGESPKGVEDGSIGKVCRTLLAKS

SEQ ID NO: 2556 - protein, 56 aa, Influenza A virus
AWKQVLAEIQDFEDEKKIPRVKNMKKTSPLKWALGENMAPEKVDFEDCKDVSDLKQ

SEQ ID NO: 2557 - protein, 56 aa, Influenza A virus
SQVYSLIRPNENPAHKSQLVWMACNSAAFEDLRVSSFIRGTRVLPRGKLSTRGVQI

SEQ ID NO: 2558 - protein, 56 aa, Influenza A virus
ASNENMDAIVSSTLELRSRYWAIRTRSGGNTNQQRASAGQISTQPTFSVQRNLPFD

SEQ ID NO: 2559 - protein, 56 aa, Influenza A virus
KRGINDRNFWRGENGRKTRIAYERMCNILKGKFQTAAQKAMMDQVRESRNPGNAEI

SEQ ID NO: 2560 - protein, 56 aa, Influenza A virus
GIITSNASMDECDAKCQTPQGAINSSLPFQNVHPVTIGECPKYVRSTKLRMVTGLR

SEQ ID NO: 2561 - protein, 56 aa, Influenza A virus
YKIFKIEKGKVVKSVELNAPNYHYEECSCYPDAGEITCVCRDNWHGSNRPWVSFDQ

SEQ ID NO: 2562 - protein, 56 aa, Influenza A virus
MDPNTVSSFQVDCFLWHVRKQVADQELGDAPFLDRLRRDQKSLKGRGSTLGLNIET

SEQ ID NO: 2563 - protein, 56 aa, Influenza A virus
IASNENMDNMGSSTLELRSGYWAIRTRSGGNTNQQRASAGQTSVQPTFSVQRNLPF

SEQ ID NO: 2564 - protein, 56 aa, Influenza A virus
DAPFLDRLRRDQKSLKGRGSTLGLNIETATLVGKQIVEWILKEESNETLKMTIASV

SEQ ID NO: 2565 - protein, 56 aa, Influenza A virus
GIITSNASMGECDAKCQTPQGAINSSLPFQNVHPVTIGECPKYVRSTKLRMVTGLR

SEQ ID NO: 2566 - protein, 56 aa, Influenza A virus
TADKRIIEMIPERNEQGQTLWSKTNDAGSDRVMVSPLAVTWWNRNGPTTSAVHYPK

SEQ ID NO: 2567 - protein, 56 aa, Influenza A virus
GGNTNQQRASAGQTSVQPTFSVQRNLPFEKSTIMAAFTGNTEGRTSDMRAEIIRMM

SEQ ID NO: 2568 - protein, 56 aa, Influenza A virus
VKPGDILLINSTGNLIAPRGYFKIRSGKSSIMRSDAPIGKCNSECITPNGSIPNDK

SEQ ID NO: 2569 - protein, 56 aa, Influenza A virus
IQNSLTIEKMVLSAFDERRNKYLEEHPSAGKDPKKTGGPIYRRVDGKWMRELVLYD

SEQ ID NO: 2570 - protein, 56 aa, Influenza A virus
MEQEQDTQWTQSTEHINIQKRGSGRQTQKLGHPNSTRLMDHYLRIMSQVDMHKQTV

SEQ ID NO: 2571 - protein, 56 aa, Influenza A virus
MGQEQDTPWILSTGHISTQKGEDGQQTPKLEHCNSTRLMGHCQKTMNQVVMPKQIV

SEQ ID NO: 2572 - protein, 36 aa, Influenza A virus
HGLKRGPSTEGVPESMREEYRKEQQNAVDADDSHFV

SEQ ID NO: 2573 - protein, 31 aa, Influenza A virus
HPLTIGECPKYVKSEKLVLATGLRNVPQIES

SEQ ID NO: 2574 - protein, 53 aa, Influenza A virus
ALSINELSNLAKGEKANVLIGQGDVVLVMKRKRDSSILTDSQTATKRIRMAIN

SEQ ID NO: 2575 - protein, 56 aa, Influenza A virus
DAPFLDRLRRDQKSLRGRGSTLGLDIRTATREGKHIVERILEEESDEALKMTIASV

SEQ ID NO: 2576 - protein, 56 aa, Human herpesvirus 6B
NQTEYANETHSTEVQTVKTFKEDRFQRTTLKSSSEPPTVQTLSVTPKKKLPSNVTA

SEQ ID NO: 2577 - protein, 56 aa, Human herpesvirus 6B
TIKVTPNTPTITAQTTESIKKVVKRSDFPRPMYTPTDIPTLTIRRNATIKTEQNTE

SEQ ID NO: 2578 - protein, 56 aa, Human herpesvirus 6B
QNRMSASTHGEINHTEIPRMTPILNAHTWEKSTTPQWPFTAETSLTTSSKSAILTW

SEQ ID NO: 2579 - protein, 56 aa, Human herpesvirus 6B
NFIKISLGETMGITPKEPTNPTQLLNVKNQTEYANETHSTEVQTVKTFKEDRFQRT

SEQ ID NO: 2580 - protein, 56 aa, Human herpesvirus 6B
TLKSSSEPPTVQTLSVTPKKKLPSNVTAKTEVQVTNNALPSSNSSHSITKVTEEPK

SEQ ID NO: 2581 - protein, 56 aa, Human herpesvirus 6B
TTVATNTTQKLESTTFATTIGIEEISDNIYSSPKNSIYLKSKSQQSTTKFTDTEHT

SEQ ID NO: 2582 - protein, 56 aa, Human herpesvirus 6B
IYSSPKNSIYLKSKSQQSTTKFTDTEHTTPILKFTTWQDAARTYMSHNTEVQNMTE

SEQ ID NO: 2583 - protein, 56 aa, Human herpesvirus 6B
DKDGFRKQKKLDLLGSWTKEKNDKAIVHSREVTGDSGDATETVTARDSPVLRKTKH

SEQ ID NO: 2584 - protein, 56 aa, Human herpesvirus 6B
KTEVQVTNNALPSSNSSHSITKVTEEPKQNRMSASTHGEINHTEIPRMTPILNAHT

SEQ ID NO: 2585 - protein, 56 aa, Human herpesvirus 6B
AGSEAKLTTHSTETGVSPHNVSLIKDLRDKDGFRKQKKLDLLGSWTKEKNDKAIVH

SEQ ID NO: 2586 - protein, 56 aa, Human herpesvirus 6B
SREVTGDSGDATETVTARDSPVLRKTKHANDIFAGLNKKYARDVSRGGKGNSRDLY

SEQ ID NO: 2587 - protein, 56 aa, Human herpesvirus 6B
LPAEAQSNTGDVDLLQDKTSIRSPSSGITDVVNGLANLNLRQNKSDVSRPWSKNTA

SEQ ID NO: 2588 - protein, 56 aa, Human herpesvirus 6B
PLKTQRRHKFPESDSVDNAGGKILIKKETLGGRDVRATTPVSSVSLMSGVEPLSSL

SEQ ID NO: 2589 - protein, 56 aa, Human herpesvirus 6B
PTENKLGRESEEANVERILEVSDPQNLFKNFKLQNDLDSVQSPFRLPNADLSRDLD

SEQ ID NO: 2590 - protein, 56 aa, Human herpesvirus 6B
RSTDVKKKSSTESREANKTLPGNDYRVTDKNSHNHPDNLTTKAYSTQNATHYTYNE

SEQ ID NO: 2591 - protein, 56 aa, Human herpesvirus 6B
KNFKLQNDLDSVQSPFRLPNADLSRDLDSVSFKDALDVKLPGNGEREIDLALQKVK

SEQ ID NO: 2592 - protein, 56 aa, Human herpesvirus 6B
TDVVNGLANLNLRQNKSDVSRPWSKNTAANADVFDPVHRLVSEQTGTPFVLNNSDV

SEQ ID NO: 2593 - protein, 56 aa, Human herpesvirus 6B
SNRTQSAKLTKAHVSSQTTNIYPQTITERSTDVKKKSSTESREANKTLPGNDYRVT

SEQ ID NO: 2594 - protein, 56 aa, Human herpesvirus 6B
TSPHIPSTNTPTPEPSPVTKNFTELQTDTIKVTPNTPTITAQTTESIKKVVKRSDF

SEQ ID NO: 2595 - protein, 56 aa, Human herpesvirus 6B
PSESILLELADFDEHGKYSEESSIESIHEDDDNVDYLKYMEVQSPTDNNIPTPSKN

SEQ ID NO: 2596 - protein, 56 aa, Human herpesvirus 6B
QDASGGSSSGTKKGEKLQGLWKGYQDDDDSELTELSDTDSDNDVQNCHGVRKTGSK

SEQ ID NO: 2597 - protein, 56 aa, Human herpesvirus 6B
ANDIFAGLNKKYARDVSRGGKGNSRDLYSGGNAEKKETSGKFNVDKEMTQNEQEPL

SEQ ID NO: 2598 - protein, 56 aa, Human herpesvirus 6B
EDDDNVDYLKYMEVQSPTDNNIPTPSKNNESPTRQKLTNIHEKDVGKMYPDTPSPD

SEQ ID NO: 2599 - protein, 56 aa, Human herpesvirus 6B
PRKSARIHNMKSEGVTCGMCVTAADSTRQDASGGSSSGTKKGEKLQGLWKGYQDDD

SEQ ID NO: 2600 - protein, 56 aa, Human herpesvirus 6B
SVSFKDALDVKLPGNGEREIDLALQKVKAGERETSDFKVGQDETLIPTQLMKVETP

SEQ ID NO: 2601 - protein, 38 aa, Human herpesvirus 6B
DKNSHNHPDNLTTKAYSTQNATHYTYNERHDLNNTDST

SEQ ID NO: 2602 - protein, 56 aa, Human herpesvirus 6B
KKLLETQPDSVVVETGSGQQDILAYSPDKRSQTKEWIQEKGSNSKCTETLPGMTFT

SEQ ID NO: 2603 - protein, 56 aa, Human herpesvirus 6B
MQKEFDIINSSESFWPMEDNKILRRSNIKVVIGKDGLNDVTSVYSSELKSLYIPVY

SEQ ID NO: 2604 - protein, 56 aa, Human herpesvirus 6B
TLGGRDVRATTPVSSVSLMSGVEPLSSLTSTNLDLRDKSHGNYRIGPSGILDFGVK

SEQ ID NO: 2605 - protein, 56 aa, Human herpesvirus 6B
TSTNLDLRDKSHGNYRIGPSGILDFGVKLPAEAQSNTGDVDLLQDKTSIRSPSSGI

SEQ ID NO: 2606 - protein, 56 aa, Human herpesvirus 6B
MTTIRGDDLSNQITQISGSSSKKEEEKKKQQMLTGVLGLQPTMANHPVLGVFLPKY

SEQ ID NO: 2607 - protein, 56 aa, Human herpesvirus 6B
SGGNAEKKETSGKFNVDKEMTQNEQEPLPNLMEAARNAGEEQYVQAGLGQRVNKIL

SEQ ID NO: 2608 - protein, 46 aa, Human herpesvirus 6B
EEKDDVIEKMVLRIRQDGETDEETVPGPGVAESLGIAAKDKSVIAS

SEQ ID NO: 2609 - protein, 56 aa, Human herpesvirus 6B
RMQNYHPDPVVEESIKEILEESLKCDVSFESLLFPELEAFDLFIPESSNDIASKNV

SEQ ID NO: 2610 - protein, 56 aa, Human herpesvirus 6B
LFTDKELDDLAVFKDGFSYPLNDLIEMYKSGLPFLDQGQANVFYFNDTVSLKHLLP

SEQ ID NO: 2611 - protein, 56 aa, Human herpesvirus 6B
KRSQTKEWIQEKGSNSKCTETLPGMTFTNSATPVKSHGAIQDTLNPESKLDKEMEA

SEQ ID NO: 2612 - protein, 56 aa, Human herpesvirus 6B
NESPTRQKLTNIHEKDVGKMYPDTPSPDVPGKSKEAKTFIEYSRQIGKEQTSPNCV

SEQ ID NO: 2613 - protein, 56 aa, Human herpesvirus 6B
PSTRSASTRSPSTRSPCGRRPSPPLARVRIASSVAAALTHRSLERIWVSRALAANP

SEQ ID NO: 2614 - protein, 56 aa, Human herpesvirus 6B
NNLLLNRFNKHQQYLKTVGYRVLNVDTNLFTDKELDDLAVFKDGFSYPLNDLIEMY

SEQ ID NO: 2615 - protein, 42 aa, Human herpesvirus 6B
GTSNDNEKCTIRSDCNSDKMEVFKLDGYPSDYDPFEENAQIY

SEQ ID NO: 2616 - protein, 56 aa, Human herpesvirus 6B
TVTHGLRAETDETYHFISKELTAAFVASKESLNLTDPKQTCIKNEFEKIITDVYMS

SEQ ID NO: 2617 - protein, 56 aa, Human herpesvirus 6B
EKFPLDNSSPSNTHEQSNHLENAIDQEQKKTPKTTNTTTNTIYRPRDNQSNISRNT

SEQ ID NO: 2618 - protein, 56 aa, Human herpesvirus 6B
SFGRAIVNFHSILTTTPSSTPSSTSASITSPHIPSTNTPTPEPSPVTKNFTELQTD

SEQ ID NO: 2619 - protein, 56 aa, Human herpesvirus 6B
AEFTNLISLGEKGIQDILHNQSGTELKLPTENKLGRESEEANVERILEVSDPQNLF

SEQ ID NO: 2620 - protein, 56 aa, Human herpesvirus 6B
ANADVFDPVHRLVSEQTGTPFVLNNSDVAGSEAKLTTHSTETGVSPHNVSLIKDLR

SEQ ID NO: 2621 - protein, 32 aa, Human herpesvirus 6B
FARSPGDLMGEMNGDLGDEGETGEGGDNGEGE

SEQ ID NO: 2622 - protein, 56 aa, Human herpesvirus 6B
RDKTKIKSPNHESKHRHADMFRNSQKTGEKFPLDNSSPSNTHEQSNHLENAIDQEQ

SEQ ID NO: 2623 - protein, 56 aa, Human herpesvirus 6B
GKQKEKRKVEDIDKKKEDEKLKQEEKKRNDEDKRPDKKDEFDEPPKEKRQKSHHET

SEQ ID NO: 2624 - protein, 56 aa, Human herpesvirus 6B
RLFSILKQHSDAELLRHMFNESHSAYISKKLHYSGNVSHIINFLFMDEFGLSLKIP

SEQ ID NO: 2625 - protein, 50 aa, Human herpesvirus 6B
RAQSDLPKQRKQRLYGNKCPGPSAAQLPGADRQRLYEKKWPGRSAVQPAG

SEQ ID NO: 2626 - protein, 56 aa, Human herpesvirus 6B
IRSPGLRAKPWVSSGHPVAFPPAPSSAPPFSKRVPSVPSSASPSAPCIGRSRPPSA

SEQ ID NO: 2627 - protein, 50 aa, Human herpesvirus 6B
LLPTCHLSRMFYQKTWRQADEDLLFVKARNDERQEFPDAGTRSAVHDVVR

SEQ ID NO: 2628 - protein, 56 aa, Human herpesvirus 6B
WEKSTTPQWPFTAETSLTTSSKSAILTWSNLLTTPKEPLTNTSLRSTNHITTQLTT

SEQ ID NO: 2629 - protein, 56 aa, Human herpesvirus 6B
GQRVESFLKIITSDYEIIKSSLESYSASKAFSVPENGPHSLMDFASLDGRMPSDLS

SEQ ID NO: 2630 - protein, 56 aa, Human herpesvirus 6B
ANGTCCPPRDVHHDRPTLQSSNSWTRTEYFEPWQDVVDAYVPINDNHCPNDSYVVF

SEQ ID NO: 2631 - protein, 56 aa, Human herpesvirus 6B
FESLLFPELEAFDLFIPESSNDIASKNVSYSSNVEEGASDEFKTLVAQSVGNCIQS

SEQ ID NO: 2632 - protein, 56 aa, Human herpesvirus 6B
IAPNLMKGNGLNVYGHVGCVDAAISDKQGGTANVASSLLNPEHQDWMRVTGTSTNL

SEQ ID NO: 2633 - protein, 56 aa, Human herpesvirus 6B
KRNLEEQSHEDGIAPTSTTFVNGAVEGALSPCVSIDNHEDQQHDELDKRVYAQGTN

SEQ ID NO: 2634 - protein, 56 aa, Human herpesvirus 6B
CRSIQKTKGHSSQTINKHKVQKHNENHVPSRSDLKQRKSNQHEDEAVTEARDFSKL

SEQ ID NO: 2635 - protein, 56 aa, Human herpesvirus 6B
PAEEPSKCSPCPPCPSPDAPQSAVPRLSALSVPSPSTARVRFSLSSLSSSSSSSSS

SEQ ID NO: 2636 - protein, 56 aa, Human herpesvirus 6B
TPILKFTTWQDAARTYMSHNTEVQNMTENFIKISLGETMGITPKEPTNPTQLLNVK

SEQ ID NO: 2637 - protein, 56 aa, Human herpesvirus 6B
SSPSYSPSPLSPPSPVSPSSPRSPFISPIRSPGLRAKPWVSSGHPVAFPPAPSSAP

SEQ ID NO: 2638 - protein, 56 aa, Human herpesvirus 6B
KKTPKTTNTTTNTIYRPRDNQSNISRNTTKCKKKRTRDDDSDSSMQNFFKKRISGT

SEQ ID NO: 2639 - protein, 56 aa, Human herpesvirus 6B
QVFSKRDTGLLVCTARRYRPIGTNIQWSLHNQTVSDDHTTDDFIRTEISGQLLYSY

SEQ ID NO: 2640 - protein, 56 aa, Human herpesvirus 6B
WGLISLDKWVGDKYFCMCTNKESGDNVIVTLPEKNVEKSIQIYNEGSTMLAFAEIT

SEQ ID NO: 2641 - protein, 43 aa, Human herpesvirus 6B
KKIYGYEHLGQALCEGGHVFYNPRDVYFQNIKMAATEPTVVRT

SEQ ID NO: 2642 - protein, 56 aa, Human herpesvirus 6B
KCDVSFESLLFPELEAFDLFIPESSNDIASKNVSYSSNVEEGASEEFKTLVGEYMN

SEQ ID NO: 2643 - protein, 56 aa, Influenza B virus
MSNMDIDGINTGTIDKTPEEITSGTSGATRPIIRPATLAPPSNKRTRNPSPEGATT

SEQ ID NO: 2644 - protein, 56 aa, Influenza B virus
HVVKTATQGEVNVTGVIPLTTTPTKSHFANLKGTKTRGKLCPKCLNCTDLDVALGR

SEQ ID NO: 2645 - protein, 56 aa, Influenza B virus
MSNMDIDGINAGTIDKTPEETTSGTSGATRPIIRPATLAPPSNKRTRNPSPERATT

SEQ ID NO: 2646 - protein, 56 aa, Influenza B virus
MSNMDIDGINTGTIDKTPEEITSGTSGTTRPIIRPATLAPPSNKRTRNPSPERATT

SEQ ID NO: 2647 - protein, 56 aa, Influenza B virus
GGNEVGGDGGSGQISCNPVFAVERPIALSKQAVRRMLSMNIEGRDADVKGNLLKMM

SEQ ID NO: 2648 - protein, 56 aa, Influenza B virus
LMVVTSNADRICTGITSSNSPHVVKTATQGEVNVTGVIPLTTTPTKSHFANLKGTK

SEQ ID NO: 2649 - protein, 56 aa, Influenza B virus
VIPLTTTPTKSHFANLKGTKTRGKLCPNCLNCTDLDVALGRPKCMGTIPSAKASIL

SEQ ID NO: 2650 - protein, 56 aa, Influenza B virus
HVVKTATQGEVNVTGVIPLTTTPTKSHFANLKGTKTRGKLCPNCLNCTDLDVALGR

SEQ ID NO: 2651 - protein, 56 aa, Influenza B virus
MSNMDIDGINTGTIDKTPEEIISGTSGATRPIIRPATLAPPSNKRTRNPSPERATT

SEQ ID NO: 2652 - protein, 52 aa, Influenza B virus
LHEKYGGLNKSKPYYTGEHAKAIGNCPIWVKTPLKLANGTKYRPPAKLLKER

SEQ ID NO: 2653 - protein, 30 aa, Influenza B virus
KTPLKQANGTKYRPAAKLLKERGFFGAIAG

SEQ ID NO: 2654 - protein, 56 aa, Influenza B virus
DLICTGITSSNSPHVVKTATQGEVNVTGVIPLTTTPTKSHFANLKGTKTRGKLCPN

SEQ ID NO: 2655 - protein, 56 aa, Influenza B virus
HVVKTATQGEVNVTGVIPLTTTPTKSHFANLKGTETRGKLCPKCLNCTDLDVALGR

SEQ ID NO: 2656 - protein, 56 aa, Influenza B virus
HVVKTATQGEVNVTGVIPLTTTPTKSHFANLKGTKTRGKLCPNCLNCTDLDVALAR

SEQ ID NO: 2657 - protein, 56 aa, Influenza B virus
EKYGGLNKSKPYYTGEHAKAIGNCPIWVKTPLKQANGTKYRPAAKLLKERGFFGAI

SEQ ID NO: 2658 - protein, 56 aa, Influenza B virus
HVVQTATQGEVNVTGVIPLTTTPTKSHFANLKGTKTRGKLCPKCLNCTDLDVALAR

SEQ ID NO: 2659 - protein, 56 aa, Influenza B virus
DRICTGITSSNSPHVVKTATQGEVNVTGVIPLTTTPTKSHFANLKGTQTRGKLCPN

SEQ ID NO: 2660 - protein, 56 aa, Influenza B virus
DRICTGITSSNSPHVVKTATQGEVNVTGVIPLTTTPTKSHFANLKGTKTRGKLCPN

SEQ ID NO: 2661 - protein, 56 aa, Influenza B virus
VIPLTTTPTKSHFANLKGTQTRGKLCPNCLNCTDLDVALGRPKCLGTIPSAKASIL

SEQ ID NO: 2662 - protein, 56 aa, Influenza B virus
HVVKTATQGEVNVTGVIPLTTTPTKSHFANLKGTKTRGKLCPKCLNCTDLDVALAR

SEQ ID NO: 2663 - protein, 56 aa, Influenza B virus
KYGGLNKSKPYYTGEHAKAIGNCPIWVKTPLKLANGTKYRPPAKLLKERGFFGAIA

SEQ ID NO: 2664 - protein, 56 aa, Influenza B virus
LMVVTSNADRICTGITSSNSPHVVKTATQGEVNVTGVIPLTTTPTRSHFANLKGTQ

SEQ ID NO: 2665 - protein, 56 aa, Influenza B virus
DRICTGITSSNSPHVVKTATQGEVNVTGVIPLTTTPTKSHFANLKGTKTRGKLCPK

SEQ ID NO: 2666 - protein, 39 aa, Influenza B virus
YYTGEHAKAIGNCPIWVKTPLKLANGTKYRPPAKLLKER

SEQ ID NO: 2667 - protein, 56 aa, Influenza B virus
VIPLTTTPTKSHFANLKGTKTRGKLCPKCLNCTDLDVALGRPKCMGTIPSAKASIL

SEQ ID NO: 2668 - protein, 56 aa, Influenza B virus
KTATQGEVNVTGVIPLTTTPTKSHFANLKGTKTRGKLCPKCLNCTDLDVALGRPKC

SEQ ID NO: 2669 - protein, 56 aa, Influenza B virus
QGEVNVTGVIPLTTTPTKSHFANLKGTKTRGKLCPNCLNCTDLDVALGRPKCMGTI

SEQ ID NO: 2670 - protein, 56 aa, Influenza B virus
TRPIIKPATLAPPSNKRTRNPSPERATTSSEAIVGRRTQKKQTPTEIKKSVYNMVV

SEQ ID NO: 2671 - protein, 56 aa, Influenza B virus
TRPIIRPATLAPPSNKRTRNPSPERATTSSEADVGRKTQKKQTPTEIKKSVYNMVV

SEQ ID NO: 2672 - protein, 39 aa, Influenza B virus
YYTGAHAKAIGNCPIWVKTPLKLANGTKYRPPAKLLKER

SEQ ID NO: 2673 - protein, 37 aa, Influenza B virus
TGEHAKAIGNCPIWVKTPLKLANGTKYRPPAKLLKER

SEQ ID NO: 2674 - protein, 56 aa, Influenza B virus
VTSNADRICTGITSSNSPHVVKTATQGEVNVTGVIPLTTTPTKSHFANLKGTQTRG

SEQ ID NO: 2675 - protein, 56 aa, Influenza B virus
QGEVNVTGVIPLTTTPTKSHFANLKGTKTRGKLCPKCLNCTDLDVAFGRPKCMGTI

SEQ ID NO: 2676 - protein, 56 aa, Influenza B virus
MSNMDIDGINTGTIDKTPEEITSGTSGATRPIIKPATLAPPSNKRTRNPSPERATT

SEQ ID NO: 2677 - protein, 29 aa, Influenza B virus
TPLKLANGTKYRPPAKLLKERGFFGAIAG

SEQ ID NO: 2678 - protein, 52 aa, Influenza B virus
LHAKYGGLNKSKPYYTGEHAKAIGNCPIWVKTPLKLANGTKYRPPAKLLKER

SEQ ID NO: 2679 - protein, 56 aa, Influenza B virus
TRPIIRPATLASPSNKRTRNPSPERATTSSEADVGRRTQKKQTPTEIKKSVYNMVV

SEQ ID NO: 2680 - protein, 54 aa, Influenza B virus
DCLHEKYGGLNKSKPYYTGEHAKAIGNCPIWVKTPLKLANGTKYRPPAKLLKER

SEQ ID NO: 2681 - protein, 56 aa, Influenza B virus
AVERILLAATDDKKTEYQKKKNARDVKEGKEEIDHNKTGGTFYKMVRDDKTIYFSP

SEQ ID NO: 2682 - protein, 56 aa, Influenza B virus
KVIKGSLPLIGQADCLHEKYGGLNKSKPYYTGEHAKAIGNCPIWVKTPLKLANGTK

SEQ ID NO: 2683 - protein, 56 aa, Influenza B virus
VIPLTTTPTKSHFANLKGTKTRGKLCPKCLNCTDLDVALGRPKCTGTIPSAKASIL

SEQ ID NO: 2684 - protein, 56 aa, Influenza B virus
MSNMDIDGINAGTIDKAPEETTSGTSGATRPIIRPATLASPSNKRTRNPSPERATT

SEQ ID NO: 2685 - protein, 56 aa, Influenza B virus
VIPLTTTPTKSHFANLKGTKTRGKLCPNCLNCTDLDVALGRPMCMGTIPSAKASIL

SEQ ID NO: 2686 - protein, 56 aa, Influenza B virus
DCLHEKYGGLNKSKPYYTGEHAKAIGNCPIWVKTPLKLANGTKYRPPAKLLKERGF

SEQ ID NO: 2687 - protein, 36 aa, Influenza B virus
GEHAKAIGNCPIWVKTPLKLANGTKYRPPAKLLKKR

SEQ ID NO: 2688 - protein, 56 aa, Influenza B virus
TATQGEVNVTGVIPLTTTPTKSHFANLKGTQTRGKLCPNCLNCTDLDVALGRPKCM

SEQ ID NO: 2689 - protein, 56 aa, Influenza B virus
QGEVNVTGVIPLTTTPTRSHFANLKGTQTRGKLCPNCFNCTDLDVALGRPKCMGNI

SEQ ID NO: 2690 - protein, 56 aa, Influenza B virus
LHEKYGGLNKSKPYYTGEHAKAIGNCPIWVKTPLKLANGTKYRPPAKLLKERGFFG

SEQ ID NO: 2691 - protein, 56 aa, Influenza B virus
TRPIIRPATLAPPSNKRTRNPSPERATTSSEDDVGRKTQKKQTPTEIKKSVYNMVV

SEQ ID NO: 2692 - protein, 56 aa, Influenza B virus
KLGEFYNQMMVKAGLNDDMERNLIQNAHAVERILLAATDDKKTEFQKKKNARDVKE

SEQ ID NO: 2693 - protein, 53 aa, Influenza B virus
RHSYQKEIQAKETMKEALSNKMEILSDHIVIEGLSAEEIIKMGETVLEVEELQ

SEQ ID NO: 2694 - protein, 56 aa, Influenza B virus
NKSKPYYTGEHAKAIGNCPIWVKTPLKLANGTKYRPPAKLLKERGFFGAIAGFLEG

SEQ ID NO: 2695 - protein, 56 aa, Influenza B virus
PQKVWCASGRSKVIKRSLPLIGEADCLHEKYGGLNKSKPYYTGEHAKAIGNCPIWV

SEQ ID NO: 2696 - protein, 56 aa, Influenza B virus
QGEVNVTGVIPLTTTPTKSHFANLKGTKTRGKLCPKCLNCTDLDVALGRPKCMGTI

SEQ ID NO: 2697 - protein, 56 aa, Influenza B virus
KLGEFYNQMMVKAGLNDDMERNLIQNAHAVERILLAATDDKKTEFQRKKNARDVKE

SEQ ID NO: 2698 - protein, 56 aa, Influenza B virus
VWCASGRSKVIKGSLPLIGEADCLHEKYGGLNKSKPYYTGEHAKAIGNCPIWVKTP

SEQ ID NO: 2699 - protein, 56 aa, Influenza B virus
LLPQKVWCASGRSKVIKGSLPLIGEADCLHAKYGGLNKSKPYYTGEHAKAIGNCPI

SEQ ID NO: 2700 - protein, 56 aa, Influenza B virus
KVIKGSFPLIGEADCLHEKYGALNKSKPYYTGAHAKAIGNCPIWVKTPLKLANGTK

SEQ ID NO: 2701 - protein, 56 aa, Influenza B virus
KVIKGSLPLIGEADCLHEKYGGLNKSKPYYTGEHAKAIGNCPIWVKTPLKLANGTK

SEQ ID NO: 2702 - protein, 52 aa, Influenza B virus
DVQKLAEELQSNIGVLRSLGASQKNGEGIAKDVMEVLKQSSMGNSALVKKYL

SEQ ID NO: 2703 - protein, 56 aa, Influenza B virus
SGRSKVIKGSLPLIGEADCLHEKYGGLNKSKPYYTGEHAKAIGNCPIWVKTPLKLA

SEQ ID NO: 2704 - protein, 56 aa, Influenza B virus
AVERILLAATDDKKTEFQKKKNARDVKEGKEEIDHNKTGGTFYKMVRDDKTIYFSP

SEQ ID NO: 2705 - protein, 56 aa, Influenza B virus
VNVTGVIPLTTTPTKSHFANLKGTQTRGKLCPNCLNCTDMDVALGRPKCMGTIPSA

SEQ ID NO: 2706 - protein, 56 aa, Influenza B virus
LLPQKVWCASGRSKVIKGSLPLIGEADCLHEKYGGLNKSKPYYTGEHAKAIGNCPI

SEQ ID NO: 2707 - protein, 56 aa, Influenza B virus
GGNEVGGDGGSGQISCSPVFAVERPIALSKQAVRRMLSMNIEGRDADVKGNLLKMM

SEQ ID NO: 2708 - protein, 56 aa, Influenza B virus
LGPSAVEIGNGCFETKHKCNQTCLDRIAAGTFNAGEFSLPTFDSLNITAASLNDDG

SEQ ID NO: 2709 - protein, 56 aa, Influenza B virus
TRPIIRPATLAPPSNKRTRNPSPERATTSSEADIGRRTQKKQTPTEIKKSVYNMVV

SEQ ID NO: 2710 - protein, 56 aa, Influenza B virus
ASGRSKVIKGSLPLIGEADCLHEKYGGLNKSKPYYTGEHAKAIGNCPIWVKTPLKL

SEQ ID NO: 2711 - protein, 56 aa, Influenza B virus
TRPIIRPATLAPPSNKRTRNPSPEGATTSSEADVGRKTQKKQTPTEIKKSVYNMVV

SEQ ID NO: 2712 - protein, 56 aa, Influenza B virus
MLGPSAVDIGNGCFETKHKCNQTCLDRIAARTFSAGEFSLPTFDSLNITAASLNDD

SEQ ID NO: 2713 - protein, 28 aa, Influenza B virus
PVEIPIKQTIPNFFFGRDTAEDYDDLDY

SEQ ID NO: 2714 - protein, 56 aa, Influenza B virus
LKKMLGPSAVDIGNGCFETKHKCNQTCLDRIAAGTFNAGEFSLPTFDSLNITAASL

SEQ ID NO: 2715 - protein, 56 aa, Influenza B virus
IKGSLPLIGEADCLHEKYGGLNKSKPYYTGEHAKAIGNCPIWVKTPLKLANGTKYR

SEQ ID NO: 2716 - protein, 56 aa, Influenza B virus
NDSMAKKTNGNAFIGKKMFQISDKNKTNPIEIPIKQTIPSFFFGRDTAEDYDDLDY

SEQ ID NO: 2717 - protein, 56 aa, Influenza B virus
NQIKRGVNMKIRIKNPNKETINREVSILRHSYQKEIQAKETMKEVLSDNMEVLSDH

SEQ ID NO: 2718 - protein, 56 aa, Influenza B virus
NDSMAKKTSGNAFIGKKMFQISDKNKTNPIEIPIKQTIPNFFFGRDTAEDYDDLDY

SEQ ID NO: 2719 - protein, 28 aa, Influenza B virus
PIEIPIKQTIPNFFFGRDTAEDYDDLDY

SEQ ID NO: 2720 - protein, 56 aa, Influenza B virus
KMLGPSAVDIGNGCFETKHKCNQTCLDRIAAGTFNAGEFSLPTFDSLNITAASLND

SEQ ID NO: 2721 - protein, 56 aa, Influenza B virus
EMDGLHNEILELDEKVDDLRADTISSQIELAVLLSNEGIINSEDEHLLALERKLKK

SEQ ID NO: 2722 - protein, 56 aa, Influenza B virus
SQIKRGVNLKIRIRNPNKETINREVSILRHSYQKEIQAKETMKEALSNKMEILSDH

SEQ ID NO: 2723 - protein, 56 aa, Influenza B virus
KGSLPLIGEADCLHEKYGGLNKSKPYYTGEHAKAIGNCPIWVKTPLKLANGTKYRP

SEQ ID NO: 2724 - protein, 56 aa, Influenza B virus
GGLNKSKPYYTGEHAKAIGNCPIWVKTPLKLANGTKYRPPAKLLKERGFFGAIAGF

SEQ ID NO: 2725 - protein, 56 aa, Influenza B virus
QKVWCASGRSKVIKGSLPLIGEADCLHEKYGGLNKSKPYYTGEHAKAIGNCPIWVK

SEQ ID NO: 2726 - protein, 56 aa, Influenza B virus
SVPGVRREMQMVSAVNTAKTMNGMGKGEDVQKLAEELQSNIGVLRSLGASQKNGEG

SEQ ID NO: 2727 - protein, 56 aa, Influenza B virus
GILLPQKVWCASGRSKVIKGSLPLIGERDCLHEKYGGLNKSKPYYTGEHAKAIGNC

SEQ ID NO: 2728 - protein, 56 aa, Influenza B virus
CASGRSKVIKGSLPLIGEADCLHEKYGGLNKSKPYYTGEHAKAIGNCPIWVKTPLK

SEQ ID NO: 2729 - protein, 56 aa, Influenza B virus
QKSGKTGTITYQRGILLPQKVWCASGRSKVIKGSLPLIGEADCLHEKYGGLNKSKP

SEQ ID NO: 2730 - protein, 56 aa, Influenza B virus
DDLRADTISSQIELAVLLSNEGIINSEDEHLLALERKLKKMLGPSAVDIGNGCFET

SEQ ID NO: 2731 - protein, 56 aa, Influenza B virus
GILLPQKVWCASGRSKVIKGSLPLIGEADCLHEKYGGLNKSKPYYTGEHAKAIGNC

SEQ ID NO: 2732 - protein, 56 aa, Influenza B virus
SVPGVRREMQMVSAMNTAKTMNGMGKGEDVQKLAEELQSNIGVLRSLGASQKNGEG

SEQ ID NO: 2733 - protein, 56 aa, Influenza B virus
SKQAVRRMLSMNIEGRDADVKGNLLKMMNDSMAKKTNGNAFIGKKMFQISDKNKIN

SEQ ID NO: 2734 - protein, 56 aa, Influenza B virus
PKDNKTATDPLTIEVPYICTKGEDQITVWGFHSDNKNQMVKLYGDSKPQKFTSSAN

SEQ ID NO: 2735 - protein, 56 aa, Influenza B virus
KALIGASICFLKPKDQERKRRFITEPLSGMGTTATKKKGLILAERKMRRCVSFHEA

SEQ ID NO: 2736 - protein, 56 aa, Influenza B virus
TDTAEIRLMCTETYLDTPRPDDGSITGPCESNGDKGRGGIKGGFVHQRMASKIGRW

SEQ ID NO: 2737 - protein, 56 aa, Influenza B virus
ATNSLTVEVPYICTEGEDQITVWGFHSDNETQMVKLYGDSKPQKFTSSANGVTTHY

SEQ ID NO: 2738 - protein, 56 aa, Influenza B virus
KSKPYYTGEHAKAIGNCPIWVKTPLKLANGTKYRPPAKLLKERGFFGAIAGFLEGG

SEQ ID NO: 2739 - protein, 56 aa, Influenza B virus
SQIELAVLLSNEGIINSEDEHLLALERKLKKMLGPSAVDIGNGCFETKHKCNQTCL

SEQ ID NO: 2740 - protein, 56 aa, Influenza B virus
PKNNNNKTATNPLTVEVPFICTEGEDQITVWGFHSDNEIQMVKLYGDSKPQKFTSS

SEQ ID NO: 2741 - protein, 56 aa, Influenza B virus
AVERILLAATDDKKTEFQRKKNARDVKEGKEEIDHNKTGGTFYKMVRDDKTIYFSP

SEQ ID NO: 2742 - protein, 56 aa, Influenza B virus
KALIGASICFLKPKDQERKRRFITEPLSGMGTTATKKKGLILAERKMRKCVSFHEA

SEQ ID NO: 2743 - protein, 56 aa, Influenza B virus
QKSGKTGTITYQRGILLPQKVWCASGRSKVIKGSLPLIGQADCLHEKYGGLNKSKP

SEQ ID NO: 2744 - protein, 56 aa, Influenza B virus
PGKTGTIVYQRGVLLPQKVWCASGRSKVIKGSLPLIGEADCLHEKYGGLNKSKPYY

SEQ ID NO: 2745 - protein, 56 aa, Influenza B virus
DPLTVEVPYICTKGEDQITVWGFHSDNEAQMVKLYGDSKPQKFTSSANGVTTHYVS

SEQ ID NO: 2746 - protein, 56 aa, Influenza B virus
LNKSKPYYTGEHAKAIGNCPIWVKTPLKLANGTKYRPPAKLLKERGFFGAIAGFLE

SEQ ID NO: 2747 - protein, 56 aa, Influenza B virus
TDTAEIRLMCTDTYLDTPRPNDGSITGPCESNGDKGSGGIKGGFVHQRMESKIGRW

SEQ ID NO: 2748 - protein, 56 aa, Influenza B virus
DTAEIRLMCTETYLDTPRPDDGSITGPCESNGDKGRGGIKGGFVHQRMASKIGRWY

SEQ ID NO: 2749 - protein, 56 aa, Influenza B virus
ANGTKYRPPAKLLKERGFFGAIAGFLEGGWEGMIDGWHGYTSHGAHGVAVAADLKS

SEQ ID NO: 2750 - protein, 56 aa, Influenza B virus
TPKKLKWEDLRPIGPHIYNHELPEVPYNAFLLMSDELGLANMTEGKSKKPKILAKE

SEQ ID NO: 2751 - protein, 56 aa, Influenza B virus
GKTGTIAYQRGVLLPQKVWCASGRSKVIKGSLPLIGEADCLHEKYGGLNKSKPYYT

SEQ ID NO: 2752 - protein, 56 aa, Influenza B virus
TEGEDQITVWGFHSDNEAQMVKLYGDSKPQKFTSSANGVTTHYVSQIGGFPNQAED

SEQ ID NO: 2753 - protein, 56 aa, Influenza B virus
MDELHNEILELDEKVDDLRADTISSQIELAVLLSNEGIINSEDEHLLALERKLKKM

SEQ ID NO: 2754 - protein, 56 aa, Influenza B virus
KLGEFYNQMMVKAGLNDDMERNLIQNAHAVERILLAATDDKKTEYQKKKNARDVKE

SEQ ID NO: 2755 - protein, 56 aa, Influenza B virus
PKNNNNKTATNPLTVEVPFICTEGEDQITVWGFHSDSETQMVKLYGDSKPQKFTSS

SEQ ID NO: 2756 - protein, 56 aa, Influenza B virus
NQIKRGVNLKIRIRNPNKETINREVSILRHSYQKEIQAKETIKEVLSDNMERLSDH

SEQ ID NO: 2757 - protein, 56 aa, Influenza B virus
GAMDELHNEILELDEKVDDLRADTISSQIELAVLLSNEGIINSEDEHLLALERKLK

SEQ ID NO: 2758 - protein, 56 aa, Influenza B virus
TVWGFHSDSETQMVKLYGDSKPQKFTSSANGVTTHYVSQIGGFPKQAEDGGLPQSG

SEQ ID NO: 2759 - protein, 56 aa, Influenza B virus
TEGEDQITVWGFHSDDETQMVKLYGDSKPQKFTSSANGVTAHYVSQIGGFPNQAED

SEQ ID NO: 2760 - protein, 56 aa, Influenza B virus
TPKKLKWEDLRPIGPHIYNHELPEVPYNAFLLMSDELGLANMTEGKSKKPKTLAKE

SEQ ID NO: 2761 - protein, 56 aa, Influenza B virus
QKSGKTGTITYQRGILLPQKVSCPSGRSKVIKGSFPLIGEADCLHEKYGALNKSKP

SEQ ID NO: 2762 - protein, 56 aa, Influenza B virus
ATNPLTVEVPYICTEGEDQITVWGFHSDNETQMVKLYGDSKPQKFTSSANGVTAHY

SEQ ID NO: 2763 - protein, 56 aa, Influenza B virus
SKQAVRRMLSMNIEGRDADVKGNLLKMMNDSMAKKTSGNAFIGKKMFQISDKNKTN

SEQ ID NO: 2764 - protein, 56 aa, Influenza B virus
NETQMVKLYGDSKPQKFTSSANGVTAHYVSQIGGFPNQAEDGGLPQSGRIVVDYMV

SEQ ID NO: 2765 - protein, 56 aa, Influenza B virus
MHDRTKIRQLPNLLRGYENIRLSTRNVINAERAPGGPYIIGTSGSCPNVTNGNGFF

SEQ ID NO: 2766 - protein, 56 aa, Influenza B virus
TPKKLTWEDLRPIGPHIYDHELPEVPYNAFLLMSDELGLANMTEGKSKKPKTLAKE

SEQ ID NO: 2767 - protein, 56 aa, Influenza B virus
MHDRTKIRQLPNLLRGYENIKLSTRNVINAERAPGGPYIIGTSGSCPNVTNGNGFF

SEQ ID NO: 2768 - protein, 56 aa, Influenza B virus
PNGYKSLSTLDRLNAYDQSGRLVAKLVATDDLTVEDEEDGHRILNSLFERFNEGHS

SEQ ID NO: 2769 - protein, 56 aa, Influenza B virus
PLTLEVPYICTKGEDQITVWGFHSDDETQMVKLYGDSKPQKFTSSANGVTTHYVSQ

SEQ ID NO: 2770 - protein, 56 aa, Influenza B virus
AGTFNAGEFSLPTFDSLNITAASLNDDGLDNHTILLYYSTAASSLAVTLMIAIFIV

SEQ ID NO: 2771 - protein, 56 aa, Influenza B virus
SSEADVGRRTQKKQTPTEIKKSVYNMVVKLGEFYNQMMVKAGLNDDMERNLIQNAH

SEQ ID NO: 2772 - protein, 56 aa, Influenza B virus
TRGKLCPNCFNCTDLDVALGRPKCMGNIPSAKVSVLHEVKPVTSGCFPIMHDRTKI

SEQ ID NO: 2773 - protein, 28 aa, Influenza B virus
PVDIPIKQTIPNFFFGRDTAEDYDDLDY

SEQ ID NO: 2774 - protein, 56 aa, Influenza B virus
ANLKGTETRGKLCPKCLNCTDLDVALGRPKCTGKIPSARVSILHEVRPVTSGCFPI

SEQ ID NO: 2775 - protein, 56 aa, Influenza B virus
NETQMVKLYGDSKPQKFTSSANGVTTHYVSQIGGFPNQAEDGGLPQSGRIVVDYMV

SEQ ID NO: 2776 - protein, 56 aa, Influenza B virus
TKIRQLPNLLRGYENIRLSARNVINAETAPGGPYIVGTSGSCPNVTNGKGFFATMA

SEQ ID NO: 2777 - protein, 56 aa, Influenza B virus
LANGTKYRPPAKLLKERGFFGAIAGFLEGGWEGMIAGWHGYTSHGAHGVAVAADLK

SEQ ID NO: 2778 - protein, 56 aa, Influenza B virus
TDTAEIRLMCTETYLDTPRPDDGSITGPCESNGEKGRGGIKGGFVHQRMASKIGRW

SEQ ID NO: 2779 - protein, 56 aa, Influenza B virus
LSGAMDELHNEILELDEKVDDLRADTISSQIELAVLLSNEGIINSEDEHLLALERK

SEQ ID NO: 2780 - protein, 56 aa, Influenza B virus
ATNPLTVEVPYICTEGEDQITVWGFHSDNETQMVKLYGDSKPQKFTSSANGVTTHY

SEQ ID NO: 2781 - protein, 56 aa, Influenza B virus
TEGEDQITVWGFHSDDETQMAKLYGDSKPQKFTSSANGVTTHYVSQIGGFPNQTED

SEQ ID NO: 2782 - protein, 56 aa, Influenza B virus
TEGEDQITVWGFHSDNETQMAKLYGDSKPQKFTSSANGVTTHYVSQIGGFPNQTED

SEQ ID NO: 2783 - protein, 56 aa, Influenza B virus
ATMAWAVPKNDKNKTATNPLTIEVPYICTEGEDQITVWGFHSDDETQMAKLYGDSK

SEQ ID NO: 2784 - protein, 56 aa, Influenza B virus
TVWGFHSDNEIQMVKLYGDSKPQKFTSSANGVTTHYVSQIGGFPKQAEDGGLPQSG

SEQ ID NO: 2785 - protein, 44 aa, Influenza B virus
HKRIKCPDCEPFCNKRDDISTPRAGVDIPSFILPGLNLSEGTPN

SEQ ID NO: 2786 - protein, 56 aa, Influenza B virus
KGVVVTKNVIDDFSSTETEKVSITKNLSLIKRTGEVIMGANDVSELESQAQLMITY

SEQ ID NO: 2787 - protein, 56 aa, Influenza B virus
TEGEDQITVWGFHSDSETQMVKLYGDSKPQKFTSSANGVTTHYVSQIGGFPNQAED

SEQ ID NO: 2788 - protein, 56 aa, Influenza B virus
KGTKTRGKLCPKCLNCTDLDVALGRPKCMGTIPSAKASILHEVKPVTSGCFPIMHD

SEQ ID NO: 2789 - protein, 56 aa, Influenza B virus
CPNCNWADYPPTPGKYLDDIEEVPENVDDPTEIVLRDMNNKDARQKIKEEVNTQKE

SEQ ID NO: 2790 - protein, 56 aa, Influenza B virus
MHDRTKIIQLPNLLRGYENIRLSTHNVINAERAPGGPYRLGTSGSCPNVTSRSGFF

SEQ ID NO: 2791 - protein, 56 aa, Influenza B virus
IMIGHSQMNDVCFQRSKALKRVGLDPSLISTFAGSTLPRRSGATGVAIKGGGTLVA

SEQ ID NO: 2792 - protein, 56 aa, Influenza B virus
LVVENLAKNICENLEQSGLPVGGNEKKAKLSNAVAKMLSNCPPGGISMTVTGDNTK

SEQ ID NO: 2793 - protein, 56 aa, Influenza B virus
TEGEDQITVWGFHSDNETQMVKLYGDSKPQKFTSSANGVTTHYVSQIGGFPNQAED

SEQ ID NO: 2794 - protein, 56 aa, Influenza B virus
AQMVKLYGDSKPQKFTSSANGVTTHYVSQIGGFPNQTEDGGIPQSGRIVVDYMVQK

SEQ ID NO: 2795 - protein, 56 aa, Influenza B virus
FHSDDETLMVILYGDSKPQKFTSSANGVTTHYVSQIGGFPNQTEDEGLKQSGRIVV

SEQ ID NO: 2796 - protein, 56 aa, Influenza B virus
CPNCNWADYPPTPGKYLDDIEEEPENVDDPTEIVLRDMNNKDARQKIKEEVNTQKE

SEQ ID NO: 2797 - protein, 56 aa, Influenza B virus
NEIQMVKLYGDSKPQKFTSSANGVTTHYVSQIGGFPNQAEDGGLPQSGRIVVDYMV

SEQ ID NO: 2798 - protein, 56 aa, Influenza B virus
KGIVVTRNVIDDFSSIETEKVSITKNLSLIKRTGEVIMGANDVSELESQAQLMITY

SEQ ID NO: 2799 - protein, 56 aa, Influenza B virus
TDTAEIRLMCTETYLDTPRPDDGSITGPCESNGDKGLGGIKGGFVHQRMASKIGRW

SEQ ID NO: 2800 - protein, 56 aa, Influenza B virus
NQIKRGVNLKIRIRNPNKETINREVSILRHSYQKEIQAKETMKEVLSDNMEILSDH

SEQ ID NO: 2801 - protein, 56 aa, Influenza B virus
ATMAWAVPKNDKNKTATNPLTIEVPYICTEGEDQITVWGFHSDNETQMAKLYGDSK

SEQ ID NO: 2802 - protein, 56 aa, Influenza B virus
NAENAPGGPYKIGTSGSCPNITNGNGFFATMAWAVPKNDKNKTATNPLTIEVPYIC

SEQ ID NO: 2803 - protein, 56 aa, Influenza B virus
LAVLLSNEGIINSEDEHLLALERKLKKMLGPSAVEIGNGCFETKHKCNQTCLDRIA

SEQ ID NO: 2804 - protein, 56 aa, Influenza B virus
CESNGDKGSGGIKGGFVHQRMESKIGRWYSRTMSKTERMGMGLYVKYDGDPWADSD

SEQ ID NO: 2805 - protein, 56 aa, Influenza B virus
PNGDKSLSTLHRLNAYDQSGRLVAKLVATDDLTVEDEEDGHRILNSLFERFNEGHS

SEQ ID NO: 2806 - protein, 56 aa, Influenza B virus
DETQMVKLYGDSKPQKFTSSANGVTTHYVSQIGGFPNQAEDGGLPQSGRIVVDHMV

SEQ ID NO: 2807 - protein, 56 aa, Influenza B virus
ATNPLTVEVPFICTEGEDQITVWGFHSDDETQMVKLYGDSKPQKFTSSANGVTTHY

SEQ ID NO: 2808 - protein, 56 aa, Influenza B virus
TEGEDQITVWGFHSDNEIQMVKLYGDSKPQKFTSSANGVTTHYVSQIGGFPNQAED

SEQ ID NO: 2809 - protein, 56 aa, Influenza B virus
MHDRTKIRQLPNLLRGYENIRLSTHNVINAETAPGGPYKIGTSGSCPNITNGNGFF

SEQ ID NO: 2810 - protein, 56 aa, Influenza B virus
MHDRTKIRQLPNLLRGYENIRLSTHNVINAERAPGGPYRLGTSGSCPNVTSKSGFF

SEQ ID NO: 2811 - protein, 56 aa, Influenza B virus
SSEADVGRKTQKKQTPTEIKKSVYNMVVKLGEFYNQMMVKAGLNDDMERNLIQNAH

SEQ ID NO: 2812 - protein, 56 aa, Influenza B virus
PNGYKTLSTLHRLNAYDQSGRLVAKLVATDDLTVEDEEDGHRILNSLFERFNEGHS

SEQ ID NO: 2813 - protein, 56 aa, Influenza B virus
QMVKLYGDSKPQKFTSSANGVTTHYVSQIGGFPNQAEDEGLPQSGRIVVDYMVQKP

SEQ ID NO: 2814 - protein, 56 aa, Influenza B virus
GYENIRLSTHNVINAETAPGGPYIVGTSGSCPNVTNGNGFFATMAWAVPKNNNNKT

SEQ ID NO: 2815 - protein, 44 aa, Influenza B virus
CKRIKCSGCEPFCNKRDDTSSLRTGVDIPSFILPGLNLSESTPN

SEQ ID NO: 2816 - protein, 56 aa, Influenza B virus
ATNPLTVEVPYICTEGEDQITVWGFHSDNEIQMVKLYGDSKPQKFTSSANGVTTHY

SEQ ID NO: 2817 - protein, 56 aa, Influenza B virus
LVVENLAKNICENLEQSGLPVGGNEKKAKLSNAVAKMLSNCPPGGVSMTVTGDNTK

SEQ ID NO: 2818 - protein, 56 aa, Influenza B virus
IVVENLAKNICENLEQSGLPVGGNEKKAKLSNAVAKMLSNCPPGGISMTVTGDNTK

SEQ ID NO: 2819 - protein, 56 aa, Influenza B virus
ELAVLLSNEGIINSEDEHLLALERKLKKMLGPSAVDIGNGCFETKHKCNQTCLDRI

SEQ ID NO: 2820 - protein, 56 aa, Influenza B virus
IMIGHSQMNDVCFQRSKALKRVGLDPSLISTFAGSTLPRRSGATGVAIKGGGTLVV

SEQ ID NO: 2821 - protein, 56 aa, Influenza B virus
QYNIIRKFNTSRIEKNPSLRMKWAMCSNFPLALTKGDMANRIPLEYKRIQLKTNAE

SEQ ID NO: 2822 - protein, 56 aa, Influenza B virus
PNGYKSLSTLHRLNAYDQSGRLVAKLVATDDLTVEDEEDGHRILNSLFERFNEGHS

SEQ ID NO: 2823 - protein, 56 aa, Influenza B virus
DETQMVKLYGDSKPQKFTSSANGVTTHYVSQIGGFPNQAEDGGLPQSGRIVVDYMV

SEQ ID NO: 2824 - protein, 56 aa, Influenza B virus
IMIGHSQMNDVCFQRSKALKRVGLDPSLISTFAGSTVPRRSGATGVAIKGGGTLVA

SEQ ID NO: 2825 - protein, 56 aa, Influenza B virus
ATNPLTVEVPFICTKGEDQITVWGFHSDDETQMVKLYGDSKPQKFTSSANGVTTHY

SEQ ID NO: 2826 - protein, 56 aa, Influenza B virus
ASNVQAVNRSATKGMTLLLSEPEWTYPRLSCQGSTFQKALLISPHRFGETRGNSAP

SEQ ID NO: 2827 - protein, 56 aa, Enterovirus C; identical to SEQ ID NO: 9

SEQ ID NO: 2828 - protein, 56 aa, Enterovirus C
MIDNTVRETVGAATSRDALPNTEASGPAHSKEIPALTAVETGATNPLVPSDTVQTR

SEQ ID NO: 2829 - protein, 56 aa, Enterovirus C
IDNTVRETVGAATSRDALPNTEASGPTHSKEIPALTAVETGATNPLVPSDTVQTRH

SEQ ID NO: 2830 - protein, 56 aa, Enterovirus C
VAQGALTLSLPKQQDSLPDTKASGPAHSKEVPALTAVETGATNPLAPSDTVQTRHV

SEQ ID NO: 2831 - protein, 56 aa, Enterovirus C
DALPNTEASGPAHSKEIPALTAVETGATNPLVPSDTVQTRHVVQHRSRSESSIESF

SEQ ID NO: 2832 - protein, 56 aa, Enterovirus C
SNALQLSQPNRPALPPAEQSVPNTNQTTPEHSKEVPALTAVETGATNPLEPGDTVQ

SEQ ID NO: 2833 - protein, 56 aa, Enterovirus C
QNALALSLPKPQSNLPDTKASGPAHSKEVPTLTAVETGATNPLVPSDTVQTRHVIQ

SEQ ID NO: 2834 - protein, 56 aa, Enterovirus C
IDNTVRETVGAATSRDALPNTEASGPAHSKEIPALTAVETGATNPLVPSDTVQTRH

SEQ ID NO: 2835 - protein, 56 aa, Enterovirus C
TAIKNALRVSQPLRPSQLKQPNGVNSQEVPALTAVETGASGQAIPSDVVETRHVIN

SEQ ID NO: 2836 - protein, 56 aa, Enterovirus C
ALAQGLGQMLESMIDNTVRETVGAATSRDALPNTEASGPAHSKEIPALTAVETGAT

SEQ ID NO: 2837 - protein, 56 aa, Enterovirus C
ITKNALVPPTSTNSLPDTKPSGPAHSKEIPALTAVETGATNPLVPSDTVQTRHVIQ

SEQ ID NO: 2838 - protein, 56 aa, Enterovirus C
NTEASGPAHSKEIPALTAVETGATNPLVPSDTVQTRHVVQHRSRSESSIESFFARG

SEQ ID NO: 2839 - protein, 56 aa, Enterovirus C
EGVTRNALTPLTPANNLPDTQSSGPAHSKETPALTAVETGATNPLVPSDTVQTRHV

SEQ ID NO: 2840 - protein, 56 aa, Enterovirus C
LPNTEASGPAHSKEIPALTAVETGATNPLVPSDTVQTRHVVQHRSRSESSIESFFA

SEQ ID NO: 2841 - protein, 56 aa, Enterovirus C
VISNALQLSQPKPQKQLTAQSTPSTSGVNSQEVPALTAVETGVSGQAIPSDVIETR

SEQ ID NO: 2842 - protein, 56 aa, Enterovirus C
IPALTAVETGATNPLVPSDTVQTRHVIQRRTRSESTVESFFARGACVAIIEVDNDA

SEQ ID NO: 2843 - protein, 56 aa, Enterovirus C
KEVPALTAVETGATNPLAPSDTVQTRHVVQRRSRSESTIESFFARGACVAIIEVDN

SEQ ID NO: 2844 - protein, 56 aa, Enterovirus C
VPALTAVETGATNPLAPSDTVQTRHVVQRRSRSESTIESFFARGACVAIIEVDNEQ

SEQ ID NO: 2845 - protein, 56 aa, Enterovirus C
AQGLGQMLESMIDNTVRETVGAATSRDALPNTEASGPAHSKEIPALTAVETGATNP

SEQ ID NO: 2846 - protein, 56 aa, Enterovirus C
EGVTRNALTPLTPVNNLPDTRSSGPAHSKETPALTAVETGATNPLVPSDTVQTRHV

SEQ ID NO: 2847 - protein, 56 aa, Enterovirus C
KETPALTAVETGATNPLVPSDTVQTRHVIQKRTRSESTVESFFARGACVAIIEVDN

SEQ ID NO: 2848 - protein, 56 aa, Enterovirus C
PTKTKLEPSAFHYVFEGVKEPAVLTKNDPRLKTDFEEAIFSKYVGNKITEVDEYMK

SEQ ID NO: 2849 - protein, 56 aa, Enterovirus C
NSQEVPALTAVETGVSGQAIPSDVIETRHVVNYKTRSESTLESFFGRSACVTMLEV

SEQ ID NO: 2850 - protein, 56 aa, Enterovirus C
QGPLQYKDLKIDVKTSPPPECINDLLQAVDSQEVRDYCEKKGWIVNITSQVQTERN

SEQ ID NO: 2851 - protein, 56 aa, Enterovirus C
SKEIPALTAVETGATNPLVPSDTVQTRHVVQHRSRSESSIESFFARGACVTIMTVD

SEQ ID NO: 2852 - protein, 56 aa, Enterovirus C
TINYYKDSASNSATRQDLSQDPSKFTEPVKDLMLKTAPALNSPNVEACGYSDRVRQ

SEQ ID NO: 2853 - protein, 56 aa, Enterovirus C
LITAGGNGVVAFADIRDLYVEEEAMEQGITSYIESLGAAFGSGFTSQIGEKISEIT

SEQ ID NO: 2854 - protein, 56 aa, Enterovirus C
GLGQMLESMIDNTVRETVGAATSRDALPNTEASGPAHSKEIPALTAVETGATNPLV

SEQ ID NO: 2855 - protein, 56 aa, Enterovirus C
VPTLTAVETGATNPLVPSDTVQTRHVIQQRSRSESTIESFFARGACVAIIEVDNEQ

SEQ ID NO: 2856 - protein, 56 aa, Enterovirus C
VPALTAVETGASGQAIPSDVVETRHVINYKTRSESCLESFFGRAACVTILSLTNSS

SEQ ID NO: 2857 - protein, 56 aa, Enterovirus C
YPIINAPSKTKLEPSAFHYVFEGVKEPAVLTKNDPRLKTNFEEAIFSKYVGNKITE

SEQ ID NO: 2858 - protein, 56 aa, Enterovirus C
INAPSKTKLEPSAFHYVFEGVKEPAVLTKNDPRLKTDFEEAIFSKYVGNKITEVDE

SEQ ID NO: 2859 - protein, 56 aa, Enterovirus C
VAFSDIRDLYAYEEEAMEQGISNYIESLGAAFGSGFTQQIGDKISELTSMVTSTIT

SEQ ID NO: 2860 - protein, 56 aa, Enterovirus C
EGLVAFTDIRDLYAYEEEAMEQGITNYIESLGAAFGSGFTQQIGDKITELTNMVTS

SEQ ID NO: 2861 - protein, 56 aa, Enterovirus C
TINYYKDSASNAASKLDFSQDPSKFTEPVKDIMLKSAPALNSPNVEACGYSDRVRQ

SEQ ID NO: 2862 - protein, 56 aa, Enterovirus C
TINYYRDSASNAASKQDFAQDPSKFTEPIKDVLIKTAPTLNSPNIEACGYSDRVMQ

SEQ ID NO: 2863 - protein, 56 aa, Enterovirus C
HSKEIPALTAVETGATNPLVPSDTVQTRHVVQHRSRSESSIESFFARGACVAIITV

SEQ ID NO: 2864 - protein, 56 aa, Enterovirus C
NAPSKTKLEPSAFHYVFEGVKEPAVLTKNDPRLRTDFEEAIFSKYVGNKITDVDEY

SEQ ID NO: 2865 - protein, 56 aa, Enterovirus C; identical to SEQ ID NO: 2847

SEQ ID NO: 2866 - protein, 56 aa, Enterovirus C
YPIINAPSKTKLEPSAFHYVFEGVKEPAVLTKNDPRLRTDFEEAIFSKYVGNKITD

SEQ ID NO: 2867 - protein, 56 aa, Enterovirus C
TINYYKDSASNAASKQDFSQDPSKFTEPVKDVLIKSAPALNSPNIEACGYSDRVMQ

SEQ ID NO: 2868 - protein, 56 aa, Enterovirus C
TINYYRDSASNAASKQDFSQDPSKFTEPIKDVLIKTAPMLNSPNIEACGYSDRVLQ

SEQ ID NO: 2869 - protein, 56 aa, Enterovirus C
APSKTKLEPSAFHYVFEGVKEPAVLTKSDPRLKTDFEEAIFSKYVGNKITEVDEYM

SEQ ID NO: 2870 - protein, 56 aa, Enterovirus C
PEHSKEVPALTAVETGATNPLEPGDTVQTRHVIQTRSRSESTVESFFARGACVTIM

SEQ ID NO: 2871 - protein, 56 aa, Enterovirus C
IINAPSKTKLEPSAFHYVFEGVKEPAVLTKNDPRLRTDFEEAIFSKYVGNKITDVD

SEQ ID NO: 2872 - protein, 56 aa, Enterovirus C
EVGYPIINAPSKTKLEPSAFHYVFEGVKEPAVLTKNDPRLRTDFEEAIFSKYVGNK

SEQ ID NO: 2873 - protein, 56 aa, Enterovirus C
VAFSDIRDLYAYEEEAMEQGISSYVESLGAAFGSGFTQQIGDKIIELTGMVTSTIT

SEQ ID NO: 2874 - protein, 56 aa, Enterovirus C
HYVFEGVKEPAVLTKNDPRLRTDFEEAIFSKYVGNKITDVDEYMKEAVDHYAGQLM

SEQ ID NO: 2875 - protein, 56 aa, Enterovirus C
SKEIPALTAVETGATNPLVPSDTVQTRHVVQHRSRSESSIESFFARGACVAIITVD

SEQ ID NO: 2876 - protein, 56 aa, Enterovirus C
PIINAPSKTKLEPSAFHYVFEGVKEPAVLTKNDPRLKTNFEEAIFSKYVGNKITEV

SEQ ID NO: 2877 - protein, 56 aa, Enterovirus C
LVAFSDIRDLYAYEEEAMEQGVSNYIESLGAAFGSGFTQQIGNKISELTSMVTSTI

SEQ ID NO: 2878 - protein, 56 aa, Enterovirus C
KRSYFTQSQGEIQWMRPSKEAGYPIINAPTKTKLEPSAFHYVFEGVKEPAVLTKND

SEQ ID NO: 2879 - protein, 56 aa, Enterovirus C
KNDPRLKTDFEEAIFSKYVGNKITEVDEYMKEAVDHYAGQLMSLDINTEQMCLEDA

SEQ ID NO: 2880 - protein, 56 aa, Enterovirus C
KNDPRLRTDFEEAIFSKYVGNKITDVDEYMKEAVDHYAGQLMSLDINTEQMCLEDA

SEQ ID NO: 2881 - protein, 56 aa, Enterovirus C
PGTGKSVATNLIARAIAEKENTSTYSLPPDPSHFDGYKQQGVVIMDDLNQNPDGAD

SEQ ID NO: 2882 - protein, 36 aa, Enterovirus C
DLTTSAGYPYVAMGKKKRDILNKQTRDTKEMRRLLD

SEQ ID NO: 2883 - protein, 56 aa, Enterovirus C
PSKTKLEPSAFHYVFEGVKEPAVLTKNDPRFKTGFEEAIFSKYVGNKITEVDEYMK

SEQ ID NO: 2884 - protein, 56 aa, Enterovirus C
PAVLTKNDPRLRTDFEEAIFSKYVGNKITDVDEYMKEAVDHYAGQLMSLDINTEQM

SEQ ID NO: 2885 - protein, 56 aa, Enterovirus C
GYPIINAPSKTKLEPSAFHYVFEGVKEPAVLTKNDPRLRTDFEEAIFSKYVGNKIT

SEQ ID NO: 2886 - protein, 56 aa, Enterovirus C
LKRSYFTQSQGEIQWMRPSKEVGYPVINAPSKTKLEPSAFHYVFEGVKEPAVLTKS

SEQ ID NO: 2887 - protein, 56 aa, Enterovirus C
FEEAIFSKYVGNKITEVDEHMKEAVDHYAGQLMSLDINTEQMCLEDAMYGTDGLEA

SEQ ID NO: 2888 - protein, 56 aa, Enterovirus C
AVLTKNDPRLRTDFEEAIFSKYVGNKITDVDEYMKEAVDHYAGQLMSLDINTEQMC

SEQ ID NO: 2889 - protein, 56 aa, Enterovirus C
TINYYRDSASNAASKQDFSQDPSKFTEPIKDVLIKTSPMLNSPNIEACGYSDRVLQ

SEQ ID NO: 2890 - protein, 56 aa, Enterovirus C
TINYYKDSASNAASKQDYSQDPSKFTEPLKDVLIKTAPALNSPNVEACGYSDRVLQ

SEQ ID NO: 2891 - protein, 56 aa, Enterovirus C
MGAQVSSQKVGAHENTNVATGGSTVNYTTINYYKDSASNAASKQDFSQDPSKFTEP

SEQ ID NO: 2892 - protein, 56 aa, Enterovirus C
NDPRLRTDFEEAIFSKYVGNKITDVDEYMKEAVDHYAGQLMSLDINTEQMCLEDAM

SEQ ID NO: 2893 - protein, 56 aa, Enterovirus C
LEPSAFHYVFEGVKEPAVLTKNDPRLRTDFEEAIFSKYVGNKITDVDEYMKEAVDH

SEQ ID NO: 2894 - protein, 56 aa, Enterovirus C
PRFKTGFEEAIFSKYVGNKITEVDEYMKEAVDHYAGQLMSLDINTEQMCLEDAMYG

SEQ ID NO: 2895 - protein, 56 aa, Enterovirus C
SVRLLRDTTHISQAAMPQGVDDLITEVAQNALALSLPKPQSNLPDTKASGPAHSKE

SEQ ID NO: 2896 - protein, 56 aa, Enterovirus C
KNDPRLKTNFEEAIFSKYVGNKITEVDEHMKEAVDHYAGQLMSLDINTEQMCLEDA

SEQ ID NO: 2897 - protein, 56 aa, Enterovirus C
GYPIINAPSKTKLEPSVFHYVFEGVKEPAVLTKNDPRLRTDFEEAIFSKYVGNKIT

SEQ ID NO: 2898 - protein, 56 aa, Enterovirus C
KKRDILNKQTRDTKEMRRLLDTYGINLPLVTYVKDELRSKTKVEQGKSRLIEASSL

SEQ ID NO: 2899 - protein, 56 aa, Enterovirus C
VGYPIINAPSKTKLEPSAFHYVFEGVKEPAVLTKNDPRLKTDFEEAIFSKYVGNKI

SEQ ID NO: 2900 - protein, 56 aa, Enterovirus C; identical to SEQ ID NO: 2862

SEQ ID NO: 2901 - protein, 56 aa, Enterovirus C
DFEEAIFSKYVGNKITDVDEYMKEAVDHYAGQLMSLDINTEQMCLEDAMYGTDGLE

SEQ ID NO: 2902 - protein, 56 aa, Enterovirus C
MCLEDAMYGTDGLEALDLTTSAGYPYVAMGKKKRDILNKQTRDTKEMRRLLDTYGI

SEQ ID NO: 2903 - protein, 56 aa, Enterovirus C
RLLRDTTHISQEAMPQGIGDMIEGAVEGITKNALVPPTSTNSLPDTKPSGPAHSKE

SEQ ID NO: 2904 - protein, 56 aa, Enterovirus C
MEALFQGPLQYKDLKIDVKTSPPPECINDLLQAVDSQEVRDYCEKKGWIVNITSQV

SEQ ID NO: 2905 - protein, 56 aa, Enterovirus C
SVATNLIARAIAEKENTSTYSLPPDPSHFDGYKQQGVVIMDDLNQNPDGADMKLFC

SEQ ID NO: 2906 - protein, 56 aa, Enterovirus C
KSVATNLIARAIAEKENTSTYSLPPDPSHFDGYKQQGVVIMDDLNQNPDGADMKLF

SEQ ID NO: 2907 - protein, 56 aa, Enterovirus C
LTKNDPRLKTNFEEAIFSKYVGNKITEVDEHMKEAVDHYAGQLMSLDINTEQMCLE

SEQ ID NO: 2908 - protein, 56 aa, Enterovirus C; identical to SEQ ID NO: 2905

SEQ ID NO: 2909 - protein, 56 aa, Enterovirus C
EALFQGPLQYKDLKIDVKTSPPPECINDLLQAVDSQEVRDYCEKKGWIVNITSQVQ

SEQ ID NO: 2910 - protein, 56 aa, Enterovirus C
QSQGEIQWMRPSKEVGYPIINAPSKTKLEPSAFHYVFEGVKEPAVLTKNDPRLKTN

SEQ ID NO: 2911 - protein, 56 aa, Enterovirus C
AGQLMSLDINTEQMCLEDAMYGTDGLEALDLSTSAGYPYVAMGKKKRDILNKQTRD

SEQ ID NO: 2912 - protein, 56 aa, Enterovirus C
IQWMKPSKEVGYPIINAPSKTKLEPSAFHYVFEGVKEPAVLTKNDPRLRTDFEEAI

SEQ ID NO: 2913 - protein, 56 aa, Enterovirus C
EGLVAFSDIRDLYAYEEEAMEQGITNYIESLGAAFGSGFTQQISDKITELTNMVTS

SEQ ID NO: 2914 - protein, 56 aa, Enterovirus C
SLPPDPSHFDGYKQQGVVIMDDLNQNPDGADMKLFCQMVSTVEFIPPMASLEEKGI

SEQ ID NO: 2915 - protein, 56 aa, Enterovirus C
VGYPVINAPSKTKLEPSVFHHVFEGAKEPAVLTKNDPRLKTDFEEAIFSKYVGNKI

SEQ ID NO: 2916 - protein, 56 aa, Enterovirus C
NDPRLRTDFEEAIFSKYVGNKITDVDEYMKEAVDHYAGQLLSLDINTEQMCLEDAM

SEQ ID NO: 2917 - protein, 54 aa, Enterovirus C
AMYGTDGLEALDLTTSAGYPYVAMGKKKRDILNKQTRDTKEMRRLLDTDGINLP

SEQ ID NO: 2918 - protein, 56 aa, Enterovirus C
EPSAFHYVFEGVKEPAVLTKNDPRLKTNFEEAIFSKYVGNKITEVDEHMKEAVDHY

SEQ ID NO: 2919 - protein, 56 aa, Enterovirus C
ILNKQTRDTKEMQKLLDTYGINLPLVTYVKDELRSKTKVEQGKSRLIEASSLNDSV

SEQ ID NO: 2920 - protein, 56 aa, Enterovirus C
PSAFHYVFEGVKEPAVLTKNDPRLRTDFEEAIFSKYVGNKITDVDEYMKEAVDHYA

SEQ ID NO: 2921 - protein, 56 aa, Enterovirus C
DPSHFDGYKQQGVVIMDDLNQNPDGADMKLFCQMVSTVEFIPPMASLEEKGILFTS

SEQ ID NO: 2922 - protein, 56 aa, Enterovirus C
CLEDAMYGTDGLEALDLTTSAGYPYVAMGKKKRDILNKQTRDTKEMQKLLDTYGIN

SEQ ID NO: 2923 - protein, 56 aa, Enterovirus C
DPRLKTDFEEAIFSKYVGNKITEVDEYMKEAVDHYAGQLMSLDINTEQMCLEDAMY

SEQ ID NO: 2924 - protein, 56 aa, Enterovirus C
GSPGTGKSVATNLIARAIAEKENTSTYSLPPDPSHFDGYKQQGVVIMDDLNQNPDG

SEQ ID NO: 2925 - protein, 56 aa, Enterovirus C
LEMLENQISTIHQSCPSQEHQEILFNNVRWLSIQSKRFAPLYALEAKRIQKLEHTI

SEQ ID NO: 2926 - protein, 56 aa, Enterovirus C
TQIQGEIQWMKPSKEVGYPIINAPSKTKLEPSAFHYVFEGVKEPAVLTKNDPRLRT

SEQ ID NO: 2927 - protein, 56 aa, Enterovirus C
IARAIAEKENTSTYSLPPDPSHFDGYKQQGVVIMDDLNQNPDGADMKLFCQMVSTV

SEQ ID NO: 2928 - protein, 56 aa, Enterovirus C
IQGEIQWMKPSKEVGYPIINAPSKTKLEPSAFHYVFEGVKEPAVLTKNDPRLRTDF

SEQ ID NO: 2929 - protein, 56 aa, Enterovirus C
QYKDLKIDIKTTPPPECINDLLQAVDSQEVRDYCEKKGWIVNITSQVQTERNINRA

SEQ ID NO: 2930 - protein, 56 aa, Enterovirus C
SVRLLRDTTHISQSALPQGIEDLISEVAQGALTLSLPKQQDSLPDTKASGPAHSKE

SEQ ID NO: 2931 - protein, 56 aa, Enterovirus C
PAVLTKNDPRLKTDFEEAIFSKYVGNKITEVDEYMKEAVDHYAGQLMSLDINTEQM

SEQ ID NO: 2932 - protein, 56 aa, Enterovirus C
HGSPGTGKSVATNLIARAIAEKENTSTYSLPPDPSHFDGYKQQGVVIMDDLNQNPD

SEQ ID NO: 2933 - protein, 56 aa, Enterovirus C
LFQGPLQYKDLKIDVKTSPPPECINDLLQAVDSQEVRDYCEKKGWIVNITSQVQTE

SEQ ID NO: 2934 - protein, 56 aa, Enterovirus C
KRDILNKQTRDTKEMQKLLDTYGINLPLVTYVKDELKSKTKVEQGKSRLIEASSLN

SEQ ID NO: 2935 - protein, 56 aa, Enterovirus C
VLTKNDPRLRTDFEEAIFSKYVGNKITDVDEYMKEAVDHYAGQLMSLDINTEQMCL

SEQ ID NO: 2936 - protein, 43 aa, Enterovirus C
SAGYPYVAMGKKKRDILNKQTRDTKEMRRLLDTYGINLPLVTY

SEQ ID NO: 2937 - protein, 56 aa, Enterovirus C
FKSKHRIEPVCLLVHGSPGTGKSVATNLIARAIAEKENTSTYSLPPDPSHFDGYKQ

SEQ ID NO: 2938 - protein, 56 aa, Enterovirus C
SVRLLRDTTHISQEAMPQGLGDLIEGVVEGVTRNALTPLTPANNLPDTQSSGPAHS

SEQ ID NO: 2939 - protein, 56 aa, Enterovirus C; identical to SEQ ID NO: 2931

SEQ ID NO: 2940 - protein, 56 aa, Enterovirus C
CLEDAMYGTDGLEALDLSTSAGYPYVAMGKKKRDILNKQTRDTKEMQRLLDTYGIN

SEQ ID NO: 2941 - protein, 56 aa, Enterovirus C
SVRLLRDTTHISQEVMPQGLGDLIEGVVEGVTRNALTPLTPVNNLPDTRSSGPAHS

SEQ ID NO: 2942 - protein, 56 aa, Enterovirus C
EDAMYGTDGLEALDLSTSAGYPYVAMGKKKRDILNKQTRDTKEMQKLLDTYGINLP

SEQ ID NO: 2943 - protein, 56 aa, Enterovirus C
LPPDPAHFDGYKQQGVVIMDDLNQNPDGLDMKLFCQMVSTVEFIPPMASLEEKGIL

SEQ ID NO: 2944 - protein, 56 aa, Enterovirus C
ALDLTTSAGYPYVAMGKKKRDILNKQTRDTKEMRRLLDTYGINLPLVTYVKDELRS

SEQ ID NO: 2945 - protein, 56 aa, Enterovirus C
EPAVLTKNDPRLRTDFEEAIFSKYVGNKITDVDEYMKEAVDHYAGQLMSLDINTEQ

SEQ ID NO: 2946 - protein, 56 aa, Enterovirus C; identical to SEQ ID NO: 2886

SEQ ID NO: 2947 - protein, 56 aa, Enterovirus C
GSPGTGKSVATSLMGRAIADKENTSTYSLPPDPAHFDGYKQQGVVIMDDLNQNPDG

SEQ ID NO: 2948 - protein, 56 aa, Enterovirus C
FAAALKRSYFTQSQGEIQWMRPSKEVGYPIINAPSKTKLEPSAFHYVFEGVKEPAV

SEQ ID NO: 2949 - protein, 56 aa, Enterovirus C
KRSYFTQNQGEIQWMRSSKEVGYPIINAPSKTKLEPSAFHYVFEGVKEPAVLTKND

SEQ ID NO: 2950 - protein, 56 aa, Enterovirus C
GQLMSLDINTEQMCLEDAMYGTDGLEALDLTTSAGYPYVAMGKKKRDILNKQTRDT

SEQ ID NO: 2951 - protein, 56 aa, Enterovirus C
GTGKSVATNLIARAIAEKENTSTYSLPPDPSHFDGYKQQGVVIMDDLNQNPDGADM

SEQ ID NO: 2952 - protein, 56 aa, Enterovirus C
MGAQVSSQKVGAHENSNRAYGGSTINYTTINYYRDSASNAASKQDFSQDPSKFTEP

SEQ ID NO: 2953 - protein, 56 aa, Enterovirus C
HGFAAALKRSYFTQSQGEIQWMKPSKEVGYPIINAPSKTKLEPSAFHYVFEGVKEP

SEQ ID NO: 2954 - protein, 56 aa, Enterovirus C
GKSVATNLIARAIAERENTSTYSLPPDPSHFDGYKQQGVVIMDDLNQNPDGADMKL

SEQ ID NO: 2955 - protein, 56 aa, Enterovirus C
LEMLENQIATIHQSCPSQEHQEILFNNVRWLSIQSKRFAPLYALEAKRIQKLEHTI

SEQ ID NO: 2956 - protein, 56 aa, Enterovirus C
LPPDPTHFDGYKQQGVVIMDDLNQNPDGNDMKLFCQMVSTVEFIPPMASLEEKGIL

SEQ ID NO: 2957 - protein, 56 aa, Enterovirus C
LQYKDLKIDIKTTPPPECINDLLQAVDSQEVRDYCEKKGWIVDITSQVQTERNINR

SEQ ID NO: 2958 - protein, 56 aa, Enterovirus C
SHGFAAALKRSYFTQSQGEIQWMRPSKEVGYPVINAPSKTKLEPSVFHHVFEGAKE

SEQ ID NO: 2959 - protein, 56 aa, Enterovirus C
EDAMYGTDGLEALDLTTSAGYPYVAMGKKKRDILNKQTRDTKEMRRLLDTYGINLP

SEQ ID NO: 2960 - protein, 56 aa, Enterovirus C
KEAVDHYAGQLMSLDINTEQMCLEDAMYGTDGLEALDLSTSAGYPYVAMGKKKRDI

SEQ ID NO: 2961 - protein, 56 aa, Enterovirus C
AMYGTDGLEALDLTTSAGYPYVAMGKKKRDILNKQTRDTKEMQKLLDTYGINLPLV

SEQ ID NO: 2962 - protein, 56 aa, Enterovirus C
DFSVRLLRDTTHISQSALPQGIEDLISEVAQGALTLSLPKQQDSLPDTKASGPAHS

SEQ ID NO: 2963 - protein, 56 aa, Enterovirus C
NKQTRDTKEMQRLLDAYGINLPLVTYVKDELRSKTKVEQGKSRLIEASSLNDSVAM

SEQ ID NO: 2964 - protein, 56 aa, Enterovirus C
LEDAMYGTDGLEALDLTTSAGYPYVAMGKKKRDILNKQTRDTKEMRRLLDTYGINL

SEQ ID NO: 2965 - protein, 56 aa, Enterovirus C
PPDPSHFDGYKQQGVVIMDDLNQNPDGADMKLFCQMVSTVEFIPPMASLEEKGILF

SEQ ID NO: 2966 - protein, 56 aa, Enterovirus C
PEMCLAGDSNTTTMHTSYQNANPGEKGGTFTGTFTPDDNQTSPARRFCPVDYLFGN

SEQ ID NO: 2967 - protein, 56 aa, Enterovirus C
VGYPIINAPSKTKLEPSAFHYVFEGVKEPAVLTKNDPRLRTDFEEAIFSKYVGNKI

SEQ ID NO: 2968 - protein, 56 aa, Enterovirus C
AALKRSYFTQSQGEIQWMRPSKEVGYPIINAPSKTKLEPSAFHYVFEGVKEPAVLT

SEQ ID NO: 2969 - protein, 56 aa, Enterovirus C; identical to SEQ ID NO: 2869

SEQ ID NO: 2970 - protein, 56 aa, Enterovirus C
KKKRDILNKQTRDTKEMRRLLDTYGINLPLVTYVKDELRSKTKVEQGKSRLIEASS

SEQ ID NO: 2971 - protein, 56 aa, Enterovirus C
ALKRSYFTQSQGEIQWMKPSKEVGYPIINAPSKTKLEPSAFHYVFEGVKEPAVLTK

SEQ ID NO: 2972 - protein, 56 aa, Enterovirus C
EAVDHYAGQLMSLDINTEQMCLEDAMYGTDGLEALDLSTSAGYPYVAMGKKKRDIL

SEQ ID NO: 2973 - protein, 56 aa, Enterovirus C
PRLKTDFEEAIFSKYVGNKITEVDEYMKEAVDHYAGQLMSLDINTEQMCLEDAMYG

SEQ ID NO: 2974 - protein, 56 aa, Enterovirus C
PSKTKLEPSAFHYVFEGVKEPAVLTKNDPRLKTDFEEAIFSKYVGNKITEVDEYMK

SEQ ID NO: 2975 - protein, 56 aa, Enterovirus C
NKQTRDTKEMQRLLDTYGINLPLVTYVKDELRSKTKVEQGKSRLIEASSLNDSVAM

SEQ ID NO: 2976 - protein, 56 aa, Enterovirus C
DTKEMRRLLDTYGINLPLVTYVKDELRSKTKVEQGKSRLIEASSLNDSVAMRMAFG

SEQ ID NO: 2977 - protein, 56 aa, Enterovirus C
KQLEMLENQISTIHQSCPSQEHQEILFNNVRWLSIQSKRFAPLYAHEAKRIQKLEH

SEQ ID NO: 2978 - protein, 56 aa, Enterovirus C
ITSYIESLGAAFGSGFTNQIGEKVSELTSMVTSSITEKLLKTLIKIISTLVIISRN

SEQ ID NO: 2979 - protein, 56 aa, Enterovirus C
SPGTGKSVATNLIARAIAEKENTSTYSLPPDPSHFDGYKQQGVVIMDDLNQNPDGA

SEQ ID NO: 2980 - protein, 56 aa, Enterovirus C; identical to SEQ ID NO: 2940

SEQ ID NO: 2981 - protein, 56 aa, Enterovirus C
KKRDILNKQTRDTKEMQKLLDTYGINLPLVTYVKDELRSKTKVEQGKSRLIEASSL

SEQ ID NO: 2982 - protein, 56 aa, Enterovirus C
LNKQTRDTKEMQRLLDTYGINLPLVTYVKDELRSKTKVEQGKSRLIEASSLNDSVA

SEQ ID NO: 2983 - protein, 56 aa, Enterovirus C
KIDVKTSPPPECINDLLQAVDSQEVRDYCEKKGWIVNITSQVQTERNINRAMTILQ

SEQ ID NO: 2984 - protein, 56 aa, Enterovirus C
MEALFQGPLQYKDLKIDVKTSPAPECINDLLQAVDSQEVRDYCEKKGWIVNITSQV

SEQ ID NO: 2985 - protein, 56 aa, Enterovirus C
SHFDGYKQQGVVIMDDLNQNPDGADMKLFCQMVSTVEFIPPMASLEEKGILFTSNY

SEQ ID NO: 2986 - protein, 56 aa, Enterovirus C
MGAQVSSQKVGAHENSNRAYGGSTINYTTINYYKDSASNAASKQDYSQDPSKFTEP

SEQ ID NO: 2987 - protein, 56 aa, Enterovirus C
EAVDHYAGQLMSLDISTEQMCLEDAMYGTDGLEALDLSTSAGYPYVAMGKKKRDIL

SEQ ID NO: 2988 - protein, 56 aa, Enterovirus C
VKDIMLKSAPALNSPNVEACGYSDRVRQITLGNSTITTQEAANAVVAYGEWPSYLD

SEQ ID NO: 2989 - protein, 36 aa, Enterovirus C
TKEMQKLLDTYGINLPLVTYVKDELRSKTKVEQGKS

SEQ ID NO: 2990 - protein, 56 aa, Enterovirus C
GKKKRDILNKQTRDTKEMQKLLDTYGINLPLVTYVKDELRSKTKVEQGKSRLIEAS

SEQ ID NO: 2991 - protein, 56 aa, Enterovirus C
TYVKDELRSKTKVEQGKSRLIEASSLNDSVAMRMAFGNLYAAFHRNPGVVTGSAVG

SEQ ID NO: 2992 - protein, 36 aa, Enterovirus C
QTRDTKEMQKLLDTYGINLPLVTYVKDELRSKTKVE

SEQ ID NO: 2993 - protein, 56 aa, Enterovirus C
YMKEAVDHYAGQLMSLDINTEQMCLEDAMYGTDGLEALDLSTSAGYPYVAMGKKKR

SEQ ID NO: 2994 - protein, 56 aa, Enterovirus C; identical to SEQ ID NO: 2923

SEQ ID NO: 2995 - protein, 56 aa, Enterovirus C
GFAAALKRSYFTQSQGEIQWMRPSKEVGYPIINAPSKTKLEPSAFHYVFEGVKEPA

SEQ ID NO: 2996 - protein, 56 aa, Enterovirus C
VATNLIARAIAEKENTSTYSLPPDPSHFDGYKQQGVVIMDDLNQNPDGADMKLFCQ

SEQ ID NO: 2997 - protein, 56 aa, Enterovirus C
TGKSVATNLIARAIAEKENTSTYSLPPDPSHFDGYKQQGVVIMDDLNQNPDGADMK

SEQ ID NO: 2998 - protein, 56 aa, Enterovirus C
PLQYKDLKIDIKTSPPPECINDLLQAVDSQEVRDYCEKKGWIVNITSQVQTERNIN

SEQ ID NO: 2999 - protein, 56 aa, Enterovirus C
GTDGLEALDLSTSAGYPYVAMGKKKRDILNKQTRDTKEMQRLLDTYGINLPLVTYV

SEQ ID NO: 3000 - protein, 56 aa, Enterovirus C
DFSVRLMRDTTHIEQKALAQGLGQMLESMIDNTVRETVGAATSRDALPNTEASGPA

SEQ ID NO: 3001 - protein, 56 aa, Enterovirus C
AMYGTDGLEALDLTTSAGYPYVAMGKKKRDILNKQTRDTKEMRRLLDTYGINLPLV

SEQ ID NO: 3002 - protein, 56 aa, Enterovirus C
PRLKTDFEEAIFSKYVGNKITEVDEYMKEAVDHYAGQLMSLDISTEQMCLEDAMYG

SEQ ID NO: 3003 - protein, 56 aa, Enterovirus C
PEMCLAGDSNTTTMHTSYQNANPGEKGGTFTGTFTPDNNQTSPARRFCPVDYLLGN

SEQ ID NO: 3004 - protein, 56 aa, Enterovirus C
DYLNHSHHLYKNKTYCVKGGMPSGCSGTSIFNSMINNLIIRTLLLKTYKGIDLDHL

SEQ ID NO: 3005 - protein, 56 aa, Enterovirus C
PDPSHFDGYKQQGVVIMDDLNQNPDGADMKLFCQMVSTVEFIPPMASLEEKGILFT

SEQ ID NO: 3006 - protein, 56 aa, Enterovirus C
VLTKNDPRLKTNFEEAIFSKYVGNKITEVDEYMKEAVDHYAGQLMSLDINTEQMCL

SEQ ID NO: 3007 - protein, 56 aa, Enterovirus C
DKQTRDTKEMQRLLDTYGINLPLVTYVKDELRSKTKVEQGKSRLIEASSLNDSVAM

SEQ ID NO: 3008 - protein, 56 aa, Enterovirus C
RDILNKQTRDTKEMRRLLDTYGINLPLVTYVKDELRSKTKVEQGKSRLIEASSLND

SEQ ID NO: 3009 - protein, 56 aa, Enterovirus C
GSHGFAAALKRSYFTQIQGEIQWMKPSKEVGYPIINAPSKTKLEPSAFHYVFEGVK

SEQ ID NO: 3010 - protein, 56 aa, Enterovirus C
TDGLEALDLSTSAGYPYVAMGKKKRDILDKQTRDTKEMQRLLDTYGINLPLVTYVK

SEQ ID NO: 3011 - protein, 56 aa, Enterovirus C
RDILNKQTRDTKEMQKLLDTYGINLPLVTYVKDELRSKTKVEQGKSRLIEASSLND

SEQ ID NO: 3012 - protein, 56 aa, Enterovirus C
PSHFDGYKQQGVVIMDDLNQNPDGADMKLFCQMVSTVEFIPPMASLEEKGILFTSN

SEQ ID NO: 3013 - protein, 56 aa, Enterovirus C
SLDISTEQMCLEDAMYGTDGLEALDLTTSAGYPYVAMGKKKRDILNKQTRDTKEMR

SEQ ID NO: 3014 - protein, 56 aa, Enterovirus C
DGYKQQGVVIMDDLNQNPDGADMKLFCQMVSTVEFIPPMASLEEKGILFTSNYVLA

SEQ ID NO: 3015 - protein, 56 aa, Enterovirus C
TDGLEALDLSTSAGYPYVAMGKKKRDILNKQTRDTKEMQRLLDAYGINLPLVTYVK

SEQ ID NO: 3016 - protein, 56 aa, Enterovirus C; identical to SEQ ID NO: 2982

SEQ ID NO: 3017 - protein, 56 aa, Enterovirus C
KLFAGHQGAYTGLPSKRPNVPTIRTAKVQGPGFDYAVAMAKRNIVTATTSKGEFTM

SEQ ID NO: 3018 - protein, 56 aa, Enterovirus C
INAPSKTKLEPSAFHYVFEGVKEPAVLTKNDPRLKTNFEEAIFSKYVGNKITEVDE

SEQ ID NO: 3019 - protein, 56 aa, Enterovirus C
EALFQGPLQYKDLRIDIKTSPPPECISDLLQSVDSQEVRDYCEKKGWIVNVSSDVT

SEQ ID NO: 3020 - protein, 56 aa, Enterovirus C
LDLSTSAGYPYVAMGKKKRDILNKQTRDTKEMQKLLDTYGINLPLVTYVKDELRSK

SEQ ID NO: 3021 - protein, 56 aa, Enterovirus C
DAMYGTDGLEALDLSTSAGYPYVAMGKKKRDILNKQTRDTKEMQKLLDTYGINLPL

SEQ ID NO: 3022 - protein, 56 aa, Enterovirus C
KRSYFTQSQGEIQWMRPSKEVGYPIINAPSKTKLEPSAFHYVFEGVKEPAVLTKND

SEQ ID NO: 3023 - protein, 56 aa, Enterovirus C
MGAQVSSQKVGAHENTNVATGGSTVNYTTINYYKDSASNAASKLDFSQDPSKFTEP

SEQ ID NO: 3024 - protein, 56 aa, Enterovirus C
TKNDPRLRTDFEEAIFSKYVGNKITDVDEYMKEAVDHYAGQLMSLDINTEQMCLED

SEQ ID NO: 3025 - protein, 56 aa, Enterovirus C
HGFAAALKRSYFTQIQGEIQWMKPSKEVGYPIINAPSKTKLEPSVFHYVFEGVKEP

SEQ ID NO: 3026 - protein, 56 aa, Enterovirus C
LVTYVKDELRSKTKVEQGKSRLIEASSLNDSVAMRMAFGNLYAAFHKNPGVITGSA

SEQ ID NO: 3027 - protein, 56 aa, Enterovirus C
NLPLVTYVKDELRSKTKVEQGKSRLIEASSLNDSVAMRMAFGNLYAAFHKNPGVVT

SEQ ID NO: 3028 - protein, 56 aa, Enterovirus C
VTAGGNGIVAFADIRDLWVYEEEAMEQGITSYIESLGAAFGSGFTNQIGEKVSELT

SEQ ID NO: 3029 - protein, 56 aa, Enterovirus C
FSVRLMRDTTHIEQKALAQGLGQMLESMIDNTVRETVGAATSRDALPNTEASGPAH

SEQ ID NO: 3030 - protein, 56 aa, Enterovirus C; identical to SEQ ID NO: 2999

SEQ ID NO: 3031 - protein, 56 aa, Enterovirus C
HFDGYKQQGVVIMDDLNQNPDGADMKLFCQMVSTVEFIPPMASLEEKGILFTSNYV

SEQ ID NO: 3032 - protein, 56 aa, Enterovirus C
GSPGTGKSIATSLIGRAIAEKENTSTYSLPPDPTHFDGYKQQGVVIMDDLNQNPDG

SEQ ID NO: 3033 - protein, 56 aa, Enterovirus C
TDVDEYMKEAVDHYAGQLMSLDINTEQMCLEDAMYGTDGLEALDLTTSAGYPYVAM

SEQ ID NO: 3034 - protein, 56 aa, Enterovirus C
EYMKEAVDHYAGQLMSLDINTEQMCLEDAMYGTDGLEALDLTTSAGYPYVAMGKKK

SEQ ID NO: 3035 - protein, 56 aa, Enterovirus C
MGAQVSTQKTGAHENQNVAANGSTINYTTINYYKDSASNSATRQDLSQDPSKFTEP

SEQ ID NO: 3036 - protein, 56 aa, Enterovirus C
VRLLRDTNHISQRTLFARAQGIEETIDTVISNALQLSQPKPQKQLTAQSTPSTSGV

SEQ ID NO: 3037 - protein, 56 aa, Enterovirus C
LPPDPSHFDGYKQQGVVIMDDLNQNPDGADMKLFCQMVSTVEFIPPMASLEEKGIL

SEQ ID NO: 3038 - protein, 56 aa, Enterovirus C
VKDLMLKTAPALNSPNVEACGYSDRVRQITLGNSTITTQEAANAIVAYGEWPTYIN

SEQ ID NO: 3039 - protein, 56 aa, Enterovirus C
EAVDHYAGQLMSLDINTEQMCLEDAMYGTDGLEALDLSTSAGYPYVTMGKKKRDIL

SEQ ID NO: 3040 - protein, 56 aa, Enterovirus C
HQEILFNNVRWLSIQSKRFAPLYALEAKRIQKLEHTINNYIQFKSKHRIEPVCLLV

SEQ ID NO: 3041 - protein, 56 aa, Enterovirus C
HGFAAALKRSYFTQIQGEIQWMKPSKEVGYPIINAPSKTKLEPSAFHYVFEGVKEP

SEQ ID NO: 3042 - protein, 56 aa, Enterovirus C
EEAIFSKYVGNKITDVDEYMKEAVDHYAGQLMSLDINTEQMCLEDAMYGTDGLEAL

SEQ ID NO: 3043 - protein, 56 aa, Enterovirus C
QMVSTVEFIPPMASLEEKGILFTSNYVLASTNSSRITPPTVAHSDALARRFAFDMD

SEQ ID NO: 3044 - protein, 56 aa, Enterovirus C
ITDVDEYMKEAVDHYAGQLMSLDINTEQMCLEDAMYGTDGLEALDLTTSAGYPYVA

SEQ ID NO: 3045 - protein, 56 aa, Enterovirus C
LPLVTYVKDELRSKTKVEQGKSRLIEASSLNDSVAMRMAFGNLYAAFHKNPGVVTG

SEQ ID NO: 3046 - protein, 56 aa, Enterovirus C
VTYVKDELKSKTKVEQGKSRLIEASSLNDSVAMRMAFGNLYAAFHKNPGVITGSAV

SEQ ID NO: 3047 - protein, 56 aa, Enterovirus C
PEFCLAGDSDTQRYTSYANANPGEKGGKFYAQFNKDTAVTSPKREFCPVDYLLGCG

SEQ ID NO: 3048 - protein, 56 aa, Enterovirus C
TEVDEYMKEAVDHYAGQLMSLDINTEQMCLEDAMYGTDGLEALDLSTSAGYPYVAM

SEQ ID NO: 3049 - protein, 56 aa, Enterovirus C
ALFQGPLQYKDLKIDVKTSPPPECINDLLQAVDSQEVRDYCEKKGWIVNITSQVQT

SEQ ID NO: 3050 - protein, 56 aa, Enterovirus C
GKKKRDILNKQTRDTKEMQRLLDTYGINLPLVTYVKDELRSKTKVEQGKSRLIEAS

SEQ ID NO: 3051 - protein, 56 aa, Enterovirus C
GIASSLIGRAIAERETTSVYSVPLAPSHFDGYKQQGYDMDDLNQNPDGMDMKLFCQ

SEQ ID NO: 3052 - protein, 56 aa, Enterovirus C
VDEYMKEAVDHYAGQLMSLDINTEQMCLEDAMYGTDGLEALDLTTSAGYPYVAMGK

SEQ ID NO: 3053 - protein, 32 aa, Enterovirus C
GYPIINAPSKTKLEPSAFHYVFEGVKEPAVLT

SEQ ID NO: 3054 - protein, 56 aa, Enterovirus C
FQGPLQYKDLKIDIKTSPPPECINDLLQAVDSQEVRDYCEKKGWIVNITSQVQTER

SEQ ID NO: 3055 - protein, 56 aa, Enterovirus C
RYKDLKIDVKTVPPPECISDLLQAVDSQEVRDYCEKKGWIVNVTSQIQLERNINRA

SEQ ID NO: 3056 - protein, 56 aa, Enterovirus C
MGKKKRDILNKQTRDTKEMRRLLDTYGINLPLVTYVKDELRSKTKVEQGKSRLIEA

SEQ ID NO: 3057 - protein, 56 aa, Enterovirus C
HMKEAVDHYAGQLMSLDINTEQMCLEDAMYGTDGLEALDLSTSAGYPYVAMGKKKR

SEQ ID NO: 3058 - protein, 56 aa, Enterovirus C
YGTDGLEALDLTTSAGYPYVAMGKKKRDILNKQTRDTKEMQKLLDTYGINLPLVTY

SEQ ID NO: 3059 - protein, 51 aa, Enterovirus C
MKEAVDHYAGQLMSLDINTEQMCLEDAMYGTDGLEALDLSTSAGYPYVAMG

SEQ ID NO: 3060 - protein, 56 aa, Enterovirus C; identical to SEQ ID NO: 3050

SEQ ID NO: 3061 - protein, 56 aa, Enterovirus C
EFIPPMASLEEKGILFTSNYVLASTNSSRITPPTVAHSDALARRFAFDMDIQVMGE

SEQ ID NO: 3062 - protein, 56 aa, Enterovirus C
FDGYKQQGVVIMDDLNQNPDGADMKLFCQMVSTVEFIPPMASLEEKGILFTSNYVL

SEQ ID NO: 3063 - protein, 56 aa, Enterovirus C
TYVKDELRSKTKVEQGKSRLIEASSLNDSVAMRMAFGNLYAAFHKNPGVVTGSAVG

SEQ ID NO: 3064 - protein, 56 aa, Enterovirus C
DILNKQTRDTKEMQKLLDTYGINLPLVTYVKDELRSKTKVEQGKSRLIEASSLNDS

SEQ ID NO: 3065 - protein, 56 aa, Enterovirus C
GLEALDLTTSAGYPYVAMGKKKRDILNKQTRDTKEMQKLLDTYGINLPLVTYVKDE

SEQ ID NO: 3066 - protein, 56 aa, Enterovirus C
IKDVLIKTAPMLNSPNIEACGYSDRVLQLTLGNSTITTQEAANSVVAYGRWPEYLR

SEQ ID NO: 3067 - protein, 56 aa, Enterovirus C; identical to SEQ ID NO: 3062

SEQ ID NO: 3068 - protein, 56 aa, Enterovirus C
DVDEYMKEAVDHYAGQLMSLDINTEQMCLEDAMYGTDGLEALDLTTSAGYPYVAMG

SEQ ID NO: 3069 - protein, 56 aa, Enterovirus C
GFAAALKRSYFTQIQGEIQWMKPSKEVGYPIINAPSKTKLEPSAFHYVFEGVKEPA

SEQ ID NO: 3070 - protein, 56 aa, Enterovirus C
QCGGVITCTGKVIGMHVGGNGSHGFAAALKRSYFTQSQGEIQWMRPSKEVGYPVIN

SEQ ID NO: 3071 - protein, 56 aa, Enterovirus C
MVSTVEFIPPMASLEEKGILFTSDYVLASTNSHSIAPPTVAHSDALTRRFAFDVEV

SEQ ID NO: 3072 - protein, 56 aa, Enterovirus C
PLVTYVKDELRSKTKVEQGKSRLIEASSLNDSVAMRMAFGNLYAAFHKNPGVVTGS

SEQ ID NO: 3073 - protein, 56 aa, Enterovirus C
KLFAGHQGAYTGLPNKRPNVPTIRTAKVQGPGFDYAVAMAKRNIVTATTSKGEFTM

SEQ ID NO: 3074 - protein, 56 aa, Enterovirus C
MYGTDGLEALDLSTSAGYPYVAMGKKKRDILNKQTRDTKEMQKLLDTYGINLPLVT

SEQ ID NO: 3075 - protein, 56 aa, Enterovirus C
SHGFAAALKRSYFTQIQGEIQWMKPSKEVGYPIINAPSKTKLEPSAFHYVFEGVKE

SEQ ID NO: 3076 - protein, 56 aa, Enterovirus C
KDPRNTQDHVRSLCLLAWHNGEEEYNKFLAKIRSVPIGRALLLPEYSTLYRRWLDS

SEQ ID NO: 3077 - protein, 56 aa, Enterovirus C
IKDVLIKTSPMLNSPNIEACGYSDRVLQLTLGNSTITTQEAANSVVAYGRWPEYLR

SEQ ID NO: 3078 - protein, 56 aa, Enterovirus C
DHLKMIAYGDDVIASYPHEVDASLLAQSGEDYGLTMTPADKSATFETVTWENVTFL

SEQ ID NO: 3079 - protein, 56 aa, Enterovirus C
TDGLEALDLSTSAGYPYVTMGKKKRDILNKQTRDTKEMQRLLDTYGINLPLVTYVK

SEQ ID NO: 3080 - protein, 56 aa, Enterovirus C
TKDPRNTQDHVRSLCLLAWHNGEEEYNKFLAKIRSVPIGRALLLPEYSTLYRRWLD

SEQ ID NO: 3081 - protein, 56 aa, Enterovirus C; identical to SEQ ID NO: 3048

SEQ ID NO: 3082 - protein, 56 aa, Enterovirus C
MGKKKRDILNKQTRDTKEMRRLLDTYGINLPLVTSVKDELRSKTKVEQGKSRLIEA

SEQ ID NO: 3083 - protein, 56 aa, Enterovirus C
MGAQVSSQKVGAHENSNRAYGGSTINYTTINYYRDSASNAASKQDFAQDPSKFTEP

SEQ ID NO: 3084 - protein, 56 aa, Enterovirus C
KFRDIRPHIPTQITETNDGVLIVNTSKYPNMYVPVGAVTEQGYLNLGGRQTARTLM

SEQ ID NO: 3085 - protein, 56 aa, Enterovirus C; identical to SEQ ID NO: 3083

SEQ ID NO: 3086 - protein, 56 aa, Enterovirus C
TKDPRNTQDHVRSLCLLAWHNGEEEYNKFLAKVRSVPIGRALLLPEYSTLYRRWLD

SEQ ID NO: 3087 - protein, 56 aa, Enterovirus C
DHLKMIAYGDDVIASYPHEVDASLLAQSGKDYGLTMTPADKSATFETVTWENVTFL

SEQ ID NO: 3088 - protein, 56 aa, Enterovirus C
LKDVLIKTAPALNSPNVEACGYSDRVLQLTLGNSTITTQEAANSVVAYGRWPEFIR

SEQ ID NO: 3089 - protein, 56 aa, Enterovirus C; identical to SEQ ID NO: 2960

SEQ ID NO: 3090 - protein, 56 aa, Enterovirus C
LPNKRPNVPTIRTAKVQGPGFDYAVAMAKRNIVTATTSKGEFTMLGVYDNVAILPT

SEQ ID NO: 3091 - protein, 56 aa, Human immunodeficiency virus 1; identical to SEQ ID NO: 12

SEQ ID NO: 3092 - protein, 56 aa, Human immunodeficiency virus 1
KDQQLLGFWGCSGKLICTTTVPWNASWSNKSLDDIWNNMTWMQWEREIDNYTSLIY

SEQ ID NO: 3093 - protein, 56 aa, Human immunodeficiency virus 1
QQLLGIWGCSGKLICTTAVPWNASWSNKSLEDIWDNMTWMQWEREIDNYTNTIYTL

SEQ ID NO: 3094 - protein, 56 aa, Human immunodeficiency virus 1
YLKDQQLLGIWGCSGKLICTTNVPWNSSWSNKSLDEIWDNMTWMEWDKQINNYTDE

SEQ ID NO: 3095 - protein, 56 aa, Human immunodeficiency virus 1
LGIWGCSGKLICTTTVPWNTSWSNKSLDKIWNNMTWMEWEREIDNYTSLIYTLLEE

SEQ ID NO: 3096 - protein, 56 aa, Human immunodeficiency virus 1
DQQLLGIWGCSGKLICTTTVPWNASWSNKSMDQIWNNMTWMEWEREIDNYTSLIYN

SEQ ID NO: 3097 - protein, 56 aa, Human immunodeficiency virus 1
LQDQRLLGMWGCSGKHICTTFVPWNSSWSNRSLDDIWNNMTWMQWEKEISNYTGII

SEQ ID NO: 3098 - protein, 56 aa, Human immunodeficiency virus 1
DQQLLGIWGCSGKIICPTNVPWNSSWSNKSQSDIWDKMTWLEWDKEVSNYTQVIYN

SEQ ID NO: 3099 - protein, 56 aa, Human immunodeficiency virus 1
RSEDITKNTKNIIVQLNEAVEINCTRPSNNTRKSIHIGPGRAFYATGDIIGDIRQA

SEQ ID NO: 3100 - protein, 56 aa, Human immunodeficiency virus 1
AVESYLKDQQLLGIWGCSGKHICTTTVPWNSSWSNKSLEEIWNNMTWIEWEREIDN

SEQ ID NO: 3101 - protein, 56 aa, Human immunodeficiency virus 1
QQLLGIWGCSGKLICTTTVPWNSSWSNRSLNDIWQNMTWMEWEREIDNYTGLIYRL

SEQ ID NO: 3102 - protein, 56 aa, Human immunodeficiency virus 1
QLRARILAVERYLKDQQLLGIWGCSGKLICTTNVPWNSSWSNKSWEEIWNNMTWME

SEQ ID NO: 3103 - protein, 56 aa, Human immunodeficiency virus 1
ARILAVERYLKDQQLLGIWGCSGKLICTTAVPWNASWSNKSLEEIWDNMTWMEWER

SEQ ID NO: 3104 - protein, 56 aa, Human immunodeficiency virus 1
RYLKDQQLLGIWGCSGKLICTTNVPWNSSWSNKSQEEIWNNMTWMEWEKEISNYSN

SEQ ID NO: 3105 - protein, 56 aa, Human immunodeficiency virus 1
IWGCSGKLICPTTVPWNLSWSNKSQDEIWGNMTWMEWEKEIGNYTDTIYRLIESAQ

SEQ ID NO: 3106 - protein, 56 aa, Human immunodeficiency virus 1
KCGKEGHQMKDCTERQANFLGKIWPSHKGRPGNFLQSRPEPTAPPAESFGFGEEIK

SEQ ID NO: 3107 - protein, 56 aa, Human immunodeficiency virus 1
QMKDCTERQANFLGKIWPSSKGRPGNFLQSRPEPTAPPAESLGLGEEIPSPKQEPK

SEQ ID NO: 3108 - protein, 56 aa, Human immunodeficiency virus 1
QMKDCTERQANFLGKMWPSNKGRPGNFLQNRPEPTAPPAESFGFGEEIAPSPKQEQ

SEQ ID NO: 3109 - protein, 56 aa, Human immunodeficiency virus 1
VLAVERYLRDQQLLGIWGCSGKLICTTTVPWNASWSNKSLNMIWNNMTWMQWEREI

SEQ ID NO: 3110 - protein, 56 aa, Human immunodeficiency virus 1
QEGHQMKDCTGRQANFLGKIWPSSKGRPGNFPQKRLEPTAPPAESFGFGEEITPSP

SEQ ID NO: 3111 - protein, 56 aa, Human immunodeficiency virus 1
LMGIWGCSGKLICTTSVPWNVSWSNKSVDDIWNNMTWMEWEREIDNYTDYIYDLLE

SEQ ID NO: 3112 - protein, 56 aa, Human immunodeficiency virus 1
NNTRKSIHIGPGRAFYATGDIIGDIRQAHCNISGGQWNKTVNQVKKELGKHFNKTI

SEQ ID NO: 3113 - protein, 56 aa, Human immunodeficiency virus 1
QQLLGIWGCSGKLICTTTVPWNASWSNKSLNEIWDNMTWMQWEREIDNYTHLIYTL

SEQ ID NO: 3114 - protein, 56 aa, Human immunodeficiency virus 1
VERYLKDQQLMGIWGCSGKFICTTAVPWNTSWSNKSFNEIWDNMTWMEWEREINNY

SEQ ID NO: 3115 - protein, 56 aa, Human immunodeficiency virus 1
GIWGCSGKLICTTNVPWNSSWSNKSQSEIWENMTWMQWEKEISNHTSTIYRLIEES

SEQ ID NO: 3116 - protein, 56 aa, Human immunodeficiency virus 1
CTERQANFLGKIWPSHKGRPGNFLQSRPEPTAPPAESFGFGEEITPSPRQETKDKE

SEQ ID NO: 3117 - protein, 56 aa, Human immunodeficiency virus 1
LLGIWGCSGKHICTTNVPWNSSWSNRSLNEIWQNMTWMEWEREIDNYTGLIYSLIE

SEQ ID NO: 3118 - protein, 56 aa, Human immunodeficiency virus 1
ESVQINCTRPNNNTRKGIHLGPGQTFYATGAIIGDIRKAHCNISGTQWNNTLEYVK

SEQ ID NO: 3119 - protein, 56 aa, Human immunodeficiency virus 1
KQLQARVLAVERYLRDQQLLGIWGCSGKLICTTTVPWNTSWSNKSLNEIWDNMTWM

SEQ ID NO: 3120 - protein, 56 aa, Human immunodeficiency virus 1
NFRVYYRDSRDPIWKGPAKLLWKGEGAVVIQDNSDIKVVPRRKAKIIRDYGKQMAG

SEQ ID NO: 3121 - protein, 56 aa, Human immunodeficiency virus 1
HQMKDCTERQANFLGKIWPSYKGRPGNFLQSRPEPTAPPFLQSRPEPTAPPEESFR

SEQ ID NO: 3122 - protein, 56 aa, Human immunodeficiency virus 1
GCSGKLICTTAVPWNTSWSNKSLDSIWNNMTWMEWEKEIENYTNTIYTLIEESQIQ

SEQ ID NO: 3123 - protein, 56 aa, Human immunodeficiency virus 1
TERQANFLGKIWPSNKGRPGNFPQSRPEPTAPPAEIFGMGEKMTSPAKQELKDREQ

SEQ ID NO: 3124 - protein, 56 aa, Human immunodeficiency virus 1
NGSLAEEGIVIRSQNISNNAKTIIVHLNESVQINCTRPNNNTRKGIHLGPGQTFYA

SEQ ID NO: 3125 - protein, 56 aa, Human immunodeficiency virus 1
TIIVQLKESVEINCTRPNNNTRKSITIGPGRAFYATGDIIGDIRQAHCNISGEKWN

SEQ ID NO: 3126 - protein, 56 aa, Human immunodeficiency virus 1
GHQLKDCTERQANFLGRIWPSHKGRPGNFLQSRPEPTAPPAESFGFGEEITPSQKQ

SEQ ID NO: 3127 - protein, 56 aa, Human immunodeficiency virus 1
ITDNTKNIIVQLNEPVQINCTRTGNNTRKSIRIGPGQAFYATGDIIGDIRRAYCNI

SEQ ID NO: 3128 - protein, 56 aa, Human immunodeficiency virus 1
MKDCTERQANFLGKIWPSHKGRPGNFLQSRPEPTAPPAESFGFGEEITPSQKQEQK

SEQ ID NO: 3129 - protein, 56 aa, Human immunodeficiency virus 1
SILDIRQGPKEPFRDYVDRFYKTLRAEQASQDVKNWMTETLLVQNANPDCKTILKA

SEQ ID NO: 3130 - protein, 53 aa, Human immunodeficiency virus 1
EIRKTLRQKKIDRLIDRIRERAEDSGNESDGDEEELSALVEMGHHAPWDVDDL

SEQ ID NO: 3131 - protein, 56 aa, Human immunodeficiency virus 1
VQLNKSVEINCTRPNNNTKKGIAIGPGRTLYAREKIIGDIRQAHCNISKAKWNDTL

SEQ ID NO: 3132 - protein, 56 aa, Human immunodeficiency virus 1
WGCSGKLICTTAVPWNSSWSNRSQEDIWNNMTWMQWDREISNYTNTIYRLLEDSQN

SEQ ID NO: 3133 - protein, 56 aa, Human immunodeficiency virus 1
VKNWMTDTLLVQNANPDCKTILKALGPGASLEEMMTACQGVGGPSHKARILAEAMS

SEQ ID NO: 3134 - protein, 56 aa, Human immunodeficiency virus 1
SILDIRQGPKEPFRDYVDRFYKTLRAEQASQEVKNWMTETLLVQNANPDCKTILKA

SEQ ID NO: 3135 - protein, 56 aa, Human immunodeficiency virus 1
RKVLFLDGIDKAQEEHEKYHSNWRAMASDFNLPPIVAKEIVASCDKCQLKGEAMHG

SEQ ID NO: 3136 - protein, 56 aa, Human immunodeficiency virus 1
ASQEVKNWMTETLLVQNANPDCKTILKALGPAATLEEMMTACQGVGGPGHKARVLA

SEQ ID NO: 3137 - protein, 52 aa, Human immunodeficiency virus 1
IRKIRRQRKIDRLIDRIRERAEDSGNESEGDTEELSKLVEMGHDAPWDVDDL

SEQ ID NO: 3138 - protein, 56 aa, Human immunodeficiency virus 1
QNFRVYYRDNRDPIWKGPAKLLWKGEGAVVIQDNSDIKVVPRRKAKIIRDYGKQMA

SEQ ID NO: 3139 - protein, 53 aa, Human immunodeficiency virus 1
EYRKILRQRKIDRLIDRIREREEDNGNESEGDQEELSALVEMGHHAPWNVDDL

SEQ ID NO: 3140 - protein, 56 aa, Human immunodeficiency virus 1
DIRQGPKEPFRDYVDRFYKTLRAEQASQDVKNWMTETLLVQNANPDCKTILKALGP

SEQ ID NO: 3141 - protein, 56 aa, Human immunodeficiency virus 1; identical to SEQ ID NO: 3136

SEQ ID NO: 3142 - protein, 56 aa, Human immunodeficiency virus 1
SPSSILDIRQGPKEPFRDYVDRFYKTLRAEQASQEVKNWMTETLLVQNANPDCKTI

SEQ ID NO: 3143 - protein, 56 aa, Human immunodeficiency virus 1
KEGHQMKDCTERQANFLGKIWPSCKGRPGNFPQSRTEPTAPPEESFRFGEETTTPY

SEQ ID NO: 3144 - protein, 56 aa, Human immunodeficiency virus 1
EGHQLKDCTERQANFLGKIWPSHKGRPGNFLQSRPEPTAPPAESFGFGEEITPSQK

SEQ ID NO: 3145 - protein, 53 aa, Human immunodeficiency virus 1
EYRRIKRQRKIDCLIDRIRERAEDSGNESEGEREELSKLVEMGHHAPWDVDDL

SEQ ID NO: 3146 - protein, 56 aa, Human immunodeficiency virus 1
TLRAEQATQEVKNWMTETLLVQNANPDCKTILKALGPGATLEEMMTACQGVGGPSH

SEQ ID NO: 3147 - protein, 56 aa, Human immunodeficiency virus 1
DNAKTIIVHLNESVQINCTRPNNNTRKRISLGPGRVFYTTGEIIGDIRKAHCNVSG

SEQ ID NO: 3148 - protein, 56 aa, Human immunodeficiency virus 1
TNNAKTIIVQLNESVAINCTRPNNNTRKSIYIGPGRAFHTTGRIIGDIRKAHCNIS

SEQ ID NO: 3149 - protein, 37 aa, Human immunodeficiency virus 1
NQSERAEDSGNESDGDKDELSTLVEMGHHAPWDIDDM

SEQ ID NO: 3150 - protein, 56 aa, Human immunodeficiency virus 1
QDVKNWMTDTLLVQNANPDCKTILRALGPGASLEEMMTACQGVGGPAHKARVLAEA

SEQ ID NO: 3151 - protein, 56 aa, Human immunodeficiency virus 1
TQEVKGWMTDTLLVQNANPDCKTILRALGPGATLEEMMTACQGVGGPSHKARVLAE

SEQ ID NO: 3152 - protein, 56 aa, Human immunodeficiency virus 1
ATQEVKGWMTETLLVQNANPDCKTILKALGPGATLEEMMTACQGVGGPSHKARILA

SEQ ID NO: 3153 - protein, 56 aa, Human immunodeficiency virus 1; identical to SEQ ID NO: 3136

SEQ ID NO: 3154 - protein, 56 aa, Human immunodeficiency virus 1
SILDIRQGPKEPFRDYVDRFFKALRAEQATQDVKNWMTDTLLVQNANPDCKTILKA

SEQ ID NO: 3155 - protein, 56 aa, Human immunodeficiency virus 1
AEQASQEVKNWMTETLLVQNANPDCKTILKALGPAATLEEMMTACQGVGGPGHKAR

SEQ ID NO: 3156 - protein, 56 aa, Human immunodeficiency virus 1; identical to SEQ ID NO: 3146

SEQ ID NO: 3157 - protein, 56 aa, Human immunodeficiency virus 1
QEGHQMKDCKNEGRQANFLGKSWSPFKGRPGNFPQTTTRKEPTAPPLESYGFQEEK

SEQ ID NO: 3158 - protein, 56 aa, Human immunodeficiency virus 1
RKRIHIGPGRAFYTTKNIIGTIRQAHCNISRAKWNDTLRQIVSKLKEQFKNKTIVF

SEQ ID NO: 3159 - protein, 56 aa, Human immunodeficiency virus 1; identical to SEQ ID NO: 3151

SEQ ID NO: 3160 - protein, 56 aa, Human immunodeficiency virus 1
GKEISNTTEIFRPGGGDMRDNWRSELYKYKVVKIEPLGVAPTKAKRRVVQREKRAV

SEQ ID NO: 3161 - protein, 56 aa, Human immunodeficiency virus 1
QLLLNGSLAEGEVVIRSENFTNNAKTIIVQLNKSVEINCTRPNNNTKKGIAIGPGR

SEQ ID NO: 3162 - protein, 53 aa, Human immunodeficiency virus 1
EYRKILRQRKIDRLINRITERAEDSGNESDGDQEELSALVERGHLAPWDVDDL

SEQ ID NO: 3163 - protein, 56 aa, Human immunodeficiency virus 1
CSERQANFLGKFWPLNKERPGNFLQNRPEPTAPPAESFGFGEKITPSLRQEMKDQE

SEQ ID NO: 3164 - protein, 56 aa, Human immunodeficiency virus 1
DNTKNIIVQLNETVQINCTRPNNNTRKSIHMGPGKAFYTTGDIIGDIRQAHCNISG

SEQ ID NO: 3165 - protein, 53 aa, Human immunodeficiency virus 1
EYKRLLRQRKIDWLIDRIRERAEDSGNESEGDTEELSTLVEMEPDNFRNDNDM

SEQ ID NO: 3166 - protein, 56 aa, Human immunodeficiency virus 1
FLEGIDQAQEDHEKYHSNWRALASDFGLPPIVAKEIIASCPKCHIKGEATHGQVDY

SEQ ID NO: 3167 - protein, 53 aa, Human immunodeficiency virus 1
EYRRIKKQRRIDCLLDRITERAEDSGNESEGDREKLSKLVEMGHHAPWDIDDL

SEQ ID NO: 3168 - protein, 56 aa, Human immunodeficiency virus 1
QARILAVERYLKDQQLLGFWGCSGKLICTTAVPWNASWSNKTLDQIWNNMTWMEWD

SEQ ID NO: 3169 - protein, 56 aa, Human immunodeficiency virus 1
RDGGTGMHDTEIFRPEGGDMRDNWRSELYKYKVVEIKPLGIAPTKAKRRVVEREKR

SEQ ID NO: 3170 - protein, 56 aa, Human immunodeficiency virus 1
RMYSPVSILDIRQGPKEPFRDYVDRFFKTLRAEQATQEVKNWMTETLLVQNANPDC

SEQ ID NO: 3171 - protein, 56 aa, Human immunodeficiency virus 1
KDCTERQANFLGRLWPSNKGRPGNFLQSRPEPTAPPESLRPEPTAPPPESFRFEEA

SEQ ID NO: 3172 - protein, 56 aa, Human immunodeficiency virus 1
KQLQARILAVERYLKDQQLLGIWGCSGKLICTTNVRWNSSWSNKSYDDIWDNMTWM

SEQ ID NO: 3173 - protein, 52 aa, Human immunodeficiency virus 1
YRKILRQRKIDRLIDRIRERAEDSGNESEGDQEELSALVEMGHDAPWDIDDL

SEQ ID NO: 3174 - protein, 56 aa, Human immunodeficiency virus 1
TRPSKTTRRRIHIGPGRAFYTTKQIAGDLRQAHCNINRARWNATLKQIVGKLRKQF

SEQ ID NO: 3175 - protein, 56 aa, Human immunodeficiency virus 1
GHQMKECTERQANFLGKIWPSNKGRPGNFLQNRTEPTAPPAESFGFGEEIAPSPKQ

SEQ ID NO: 3176 - protein, 53 aa, Human immunodeficiency virus 1
EYRKILRQRKIDRLIDKIRERAEDSGNESEGDQEELSALVERGHLAPWDINDL

SEQ ID NO: 3177 - protein, 56 aa, Human immunodeficiency virus 1
EVVIRSENFTDNAKTIIVQLKEPVVINCTRPSKTTRRRIHIGPGRAFYTTKQIAGD

SEQ ID NO: 3178 - protein, 56 aa, Human immunodeficiency virus 1
IDKAQEDHEKYHSNWRAMASDFNLPPVVAKEIVASCDKCQLKGEAMHGQVDCSPGI

SEQ ID NO: 3179 - protein, 56 aa, Human immunodeficiency virus 1; identical to SEQ ID NO: 3154

SEQ ID NO: 3180 - protein, 56 aa, Human immunodeficiency virus 1
VKGWMTDTLLVQNANPDCKTILKALGPGATLEEMMTACQGVGGPSHKARVLAEAMS

SEQ ID NO: 3181 - protein, 56 aa, Human immunodeficiency virus 1
RARLQALETLIQNQQRLNLWGCKGKLICYTSVKWNTSWSGRYNDDSIWDNLTWQQW

SEQ ID NO: 3182 - protein, 56 aa, Human immunodeficiency virus 1
CTERQANFLGKIWPSNKGRPGNFIQNRPEPSAPPAESFRFGEETTPSPKQEQKDEG

SEQ ID NO: 3183 - protein, 56 aa, Human immunodeficiency virus 1
KAQEEHEKYHNNWRAMASDFNLPPIVAKEIVASCDKCQLKGEAMHGQVDCSPGIWQ

SEQ ID NO: 3184 - protein, 56 aa, Human immunodeficiency virus 1
GIKQLQARVLAVERYLRDQQLLGIWGCSGKLICTTNVPWNSSWSNKSQSEIWDNMT

SEQ ID NO: 3185 - protein, 56 aa, Human immunodeficiency virus 1
LKTPVNITCTRPNNNTRTSIHLGPGRAFYATGDIIGDIRQAHCNISRTDWNKTLHQ

SEQ ID NO: 3186 - protein, 56 aa, Human immunodeficiency virus 1
ASQDVKNWMTETLLVQNANPDCKTILKALGPQATLEEMMTACQGVGGPSHKARVLA

SEQ ID NO: 3187 - protein, 56 aa, Human immunodeficiency virus 1
TIIVHLNESVEINCTRPNNNTRKSIRIGPGQAFYATGEIIGDIRQAHCNISRTAWN

SEQ ID NO: 3188 - protein, 56 aa, Human immunodeficiency virus 1
VSILDIRQGPKEPFRDYVDRFYKTLRAEQASQEVKGWMTETLLVQNANPDCKTILK

SEQ ID NO: 3189 - protein, 56 aa, Human immunodeficiency virus 1
DGGKNESEIEIFRPGGGDMRDNWRSELYKYKVVKIEPLGVAPTKAKRRVVQREKRA

SEQ ID NO: 3190 - protein, 56 aa, Human immunodeficiency virus 1
SILDIKQGPKEPFRDYVDRFFKTLRAEQATQEVKGWMTETLLVQNANPDCKTILKA

SEQ ID NO: 3191 - protein, 56 aa, Human immunodeficiency virus 1
IKQLQTRVLAIERHLRDQQLLGIWGCSGKLICTTAVPWNSSWSNKSQEEIWDNMTW

SEQ ID NO: 3192 - protein, 56 aa, Human immunodeficiency virus 1; identical to SEQ ID NO: 3150

SEQ ID NO: 3193 - protein, 56 aa, Human immunodeficiency virus 1
YKLKHIVWASRELERFAVNPGLLETSEGCRQILGQLQPSLQTGSEELRSLYNTVAT

SEQ ID NO: 3194 - protein, 56 aa, Human immunodeficiency virus 1
VYYRDSRDPIWKGPAQLLWKGEGAVVIQDKGDIKVVPRRKAKIIRDYGKQMAGTDS

SEQ ID NO: 3195 - protein, 53 aa, Human immunodeficiency virus 1
EYRKILRQRKIDRLFDRIREKAEDSGNESERDQEELSALVEMGHLAPWDVDDL

SEQ ID NO: 3196 - protein, 56 aa, Human immunodeficiency virus 1
IRQGPKEPFRDYVDRFFKTLRAEQATQEVKNWMTDTLLVQNANPDCKTILKALGPG

SEQ ID NO: 3197 - protein, 56 aa, Human immunodeficiency virus 1
SILDIKQGPKEPFRDYVDRFFKTLRAEQATQDVKNWMTETLLVQNANPDCKTILRA

SEQ ID NO: 3198 - protein, 56 aa, Human immunodeficiency virus 1
NTKTIIVQFKNPVKINCTRPNNNTRRSIHIGPGRAFYATGEIIGDTRKAHCNISEK

SEQ ID NO: 3199 - protein, 56 aa, Human immunodeficiency virus 1; identical to SEQ ID NO: 3134

SEQ ID NO: 3200 - protein, 56 aa, Human immunodeficiency virus 1
TQEVKNWMTETLLVQNANPDCKQILKSLGPGATLEEMMVACQGVGGPTHKARVLAE

SEQ ID NO: 3201 - protein, 53 aa, Human immunodeficiency virus 1
EYRKIRRQRKIDKLIDRISERAEDSGNESEGDQEELSALVGMGHDAPWVINDL

SEQ ID NO: 3202 - protein, 54 aa, Human immunodeficiency virus 1
EYRKLLRQRKIDRLIDRIRERAEDSGNESEGDQEELSALVEMGGHDAPWDIDDL

SEQ ID NO: 3203 - protein, 56 aa, Human immunodeficiency virus 1
LDIKQGPKEPFRDYVDRFFKTLRAEQATQDVKNWMTDTLLVQNANPDCKTILRALG

SEQ ID NO: 3204 - protein, 56 aa, Human immunodeficiency virus 1
ILDIRQGPKEPFRDYVDRFFKTLRAEQATQEVKGWMTDTLLVQNANPDCKTILRAL

SEQ ID NO: 3205 - protein, 56 aa, Human immunodeficiency virus 1
CSGKLICTTAVPWNASWSNKSLDQIWNNMTWMEWEREIDNYTNLIYTLIEESQNQQ

SEQ ID NO: 3206 - protein, 56 aa, Human immunodeficiency virus 1
NASAENYTFRPGGGDMRDNWRSELYKYKVVKIEPLGIAPTKTRRRVVEREKRAVGM

SEQ ID NO: 3207 - protein, 56 aa, Human immunodeficiency virus 1
VKNWMTETLLVQNANPDCKSILRALGPGATLEEMMTACQGVGGPGHKARVLAEAMS

SEQ ID NO: 3208 - protein, 52 aa, Human immunodeficiency virus 1
YKKLVRQKKIDRLIERIGERAEDSGNESDGDTEELSKLMEMGHLNLGYVADL

SEQ ID NO: 3209 - protein, 56 aa, Human immunodeficiency virus 1
WGIKQLQARVLAVERYLKDQQLLGLWGCSGKLICTTNVPWNSSWSNKSLEEIWGNM

SEQ ID NO: 3210 - protein, 34 aa, Human immunodeficiency virus 1
ERAEDSGNESEGDHEELSALVDMGHDALWDVDDL

SEQ ID NO: 3211 - protein, 56 aa, Human immunodeficiency virus 1
EPHSTKEIFRPEGGDMRDNWRSELYKYKVVEIKPLGVAPTKPKRRVVEREKRAALG

SEQ ID NO: 3212 - protein, 56 aa, Human immunodeficiency virus 1
NFTDNAKTIIVHLNESVQINCTRPNYNKRKRIHIGPGRAFYTTKNIIGTIRQAHCN

SEQ ID NO: 3213 - protein, 56 aa, Human immunodeficiency virus 1
ILDIRQGPKEPFRDYVDRFYKTLRAEQATQEVKNWMTETLLVQNSNPDCKQILKAL

SEQ ID NO: 3214 - protein, 56 aa, Human immunodeficiency virus 1
AKTIIVHLNESVEINCTRPNNNVRRRHIHIGPGRAFYTGEIRGNIRQAHCNISRAK

SEQ ID NO: 3215 - protein, 56 aa, Human immunodeficiency virus 1
KTRKRVTMGPGRVYYTTGEIIGDIRQAHCNISRAEWNKTLEQIANKLRKQFENKTI

SEQ ID NO: 3216 - protein, 56 aa, Human immunodeficiency virus 1
GKLICTTNVPWNSSWSNKSQSEIWDNMTWMEWDKQISNYTEEIYRLLEVSQTQQEK

SEQ ID NO: 3217 - protein, 56 aa, Human immunodeficiency virus 1
LLTRDGGNSTETETEIFRPGGGDMRDNWRSELYKYKVVRIEPIGVAPTRAKRRTVQ

SEQ ID NO: 3218 - protein, 56 aa, Human immunodeficiency virus 1; identical to SEQ ID NO: 3203

SEQ ID NO: 3219 - protein, 56 aa, Human immunodeficiency virus 1
GHQMKDCTERQANFLGKIWPSSKGRPGNFLQSRPEPTAPPAESFGFGEEMTPSPKQ

SEQ ID NO: 3220 - protein, 56 aa, Human immunodeficiency virus 1
RDGGNDNNTRTEETFRPGGGDMRDNWRSELYKYKVVQIEPLGIAPTRARRRVVQRE

SEQ ID NO: 3221 - protein, 53 aa, Human immunodeficiency virus 1
EYKKLVRQRKINRLYKRISERAEDSGNESEGDAEELAALGEVGPFIPGDINNL

SEQ ID NO: 3222 - protein, 56 aa, Human immunodeficiency virus 1
YKMKHLIWASRELERFALDPGLLETSEGCQKIIRQLQPSLQTGSEELKSLFNTVAV

SEQ ID NO: 3223 - protein, 56 aa, Human immunodeficiency virus 1
IVQLNESVVINCTRPNNNTRKSINIGPGRALYTTGEIIGDIRQAHCNLSKTQWENT

SEQ ID NO: 3224 - protein, 56 aa, Human immunodeficiency virus 1; identical to SEQ ID NO: 3193

SEQ ID NO: 3225 - protein, 56 aa, Human immunodeficiency virus 1
MGGKWSKSSVVGWPAVRERMRRAEPAADGVGAASRDLEKHGAITSSNTAANNAACA

SEQ ID NO: 3226 - protein, 56 aa, Human immunodeficiency virus 1
PVSILDIKQGPKEPFRDYVDRFFRVLRAEQATQDVKNWMTDTLLVQNANPDCRTIL

SEQ ID NO: 3227 - protein, 56 aa, Human immunodeficiency virus 1
KLICTTAVPWNSSWSNKSQEEIWDNMTWMQWDREISNYTDIIYNLLEVSQNQQDKN

SEQ ID NO: 3228 - protein, 56 aa, Human immunodeficiency virus 1
GANNSSHETIRPGGGDMRDNWRSELYKYKVVKIEPIGVAPTKARRRVVEREKRAIG

SEQ ID NO: 3229 - protein, 56 aa, Human immunodeficiency virus 1
TNGTEIFRPGGGDMRDNWRSELYKYKVVKIEPLGVAPTKAKRRVVQREKRAVGLGA

SEQ ID NO: 3230 - protein, 56 aa, Human immunodeficiency virus 1
CFNCGKEGHIAKNCRAPRKKGCWRCGKEGHQLKDCTERQANFLGRIWPSHKGRPGN

SEQ ID NO: 3231 - protein, 56 aa, Human immunodeficiency virus 1; identical to SEQ ID NO: 3170

SEQ ID NO: 3232 - protein, 56 aa, Human immunodeficiency virus 1
REALLDTGADDTVLEDIDLPRKWKPKMIGGIGGFIKVRQYNEVPIEIEGKKAIGTV

SEQ ID NO: 3233 - protein, 56 aa, Human immunodeficiency virus 1
NWRAMASDFNLPPVVAKEIVASCDKCQLKGEAMHGQVDCSPGIWQLDCTHLEGKVI

SEQ ID NO: 3234 - protein, 56 aa, Human immunodeficiency virus 1
EGHIARNCRAPRKKGCWKCGKEGHQMKDCTERQANFLGKIWPSHKGRPGNFLQSRP

SEQ ID NO: 3235 - protein, 56 aa, Human immunodeficiency virus 1
PVSILEIKQGPKEPFRDYVDRFYKTLRAEQATQEVKNWMTETLLVQNANPDCKQLL

SEQ ID NO: 3236 - protein, 56 aa, Human immunodeficiency virus 1
NCGKEGHIARNCRAPRKRGCWKCGQEGHQMKDCTERQANFLGKMWPSNKGRPGNFL

SEQ ID NO: 3237 - protein, 56 aa, Human immunodeficiency virus 1; identical to SEQ ID NO: 3203

SEQ ID NO: 3238 - protein, 56 aa, Human immunodeficiency virus 1
LYCVHQRIEIKDTKEALDKIEEEQNKSKKKAQQAAADTGHSSQVSQNYPIVQNIQG

SEQ ID NO: 3239 - protein, 56 aa, Human immunodeficiency virus 1; identical to SEQ ID NO: 3213

SEQ ID NO: 3240 - protein, 56 aa, Human immunodeficiency virus 1
TGLLLTRDGGTNNSSNETFRPGGGDMRDNWRSELYKYKVVKIEPLGVAPTKAKRRV

SEQ ID NO: 3241 - protein, 56 aa, Human immunodeficiency virus 1
MGGKWSKSSIVGWPAIRERMRRARPAADRVGTQPAADGVGAVSQDLARHGAVTSSN

SEQ ID NO: 3242 - protein, 53 aa, Human immunodeficiency virus 1
LIRKILRQRKIDRLIDRIRERAEDSGNESEGIRKELSALVEMGHDAPGDIDDL

SEQ ID NO: 3243 - protein, 56 aa, Human immunodeficiency virus 1
EQATQDVKNWMTDTLLVQNANPDCRTILKALGRGASIEEMMTACQGVGGPSHKARV

SEQ ID NO: 3244 - protein, 49 aa, Human immunodeficiency virus 1
QSRPEPTAPPAESLGLGEEIPSPKQEPKDKELYPLTSLKSLFGSDPLSQ

SEQ ID NO: 3245 - protein, 56 aa, Human immunodeficiency virus 1
EQATQEVKNWMTETLLVQNANPDCKQLLKALGPGATLEEMMTACQGVGGPAHKARV

SEQ ID NO: 3246 - protein, 56 aa, Human immunodeficiency virus 1
AILKCNNKTFNGTGLCRNVSTVQCTHGIKPVVSTQLLLNGSLAEEKMIIRSENISD

SEQ ID NO: 3247 - protein, 56 aa, Human immunodeficiency virus 1
LTIDGGEGNESETLRPGGGDMRDNWRSELYKYKVVKIEPLGVAPTKAKRQVVQREK

SEQ ID NO: 3248 - protein, 56 aa, Human immunodeficiency virus 1; identical to SEQ ID NO: 3225

SEQ ID NO: 3249 - protein, 56 aa, Human immunodeficiency virus 1
YRLKHIVWASRELERYALNPGLLETSEGCKQIIGQLQPAIQTGTEELRSLYNTVAT

SEQ ID NO: 3250 - protein, 56 aa, Human immunodeficiency virus 1
KKAQQAAADTGNRGNSSQVSQNYPIVQNIQGQMVHQAISPRTLNAWVKVVEEKAFS

SEQ ID NO: 3251 - protein, 56 aa, Human immunodeficiency virus 1
MGGKWSKRSMGGWSAIRERMRRAEPRAEPAADGVGAVSRDLEKHGAITSSNTAATN

SEQ ID NO: 3252 - protein, 56 aa, Human immunodeficiency virus 1
MGKIWSKSSLVGWPEIRERMRRQTQEPAVEPAVGAGAASQDLANRGAITIRNTRDN

SEQ ID NO: 3253 - protein, 56 aa, Human immunodeficiency virus 1
QLTVWGIKQLQARILAVERYLKDQQLLGIWGCSGKLICPTTVPWNLSWSNKSQDEI

SEQ ID NO: 3254 - protein, 56 aa, Human immunodeficiency virus 1
CFNCGKEGHLARNCRAPRKKGCWKCGKEGHQMKECTERQANFLGKIWPSNKGRPGN

SEQ ID NO: 3255 - protein, 56 aa, Human immunodeficiency virus 1
TVWGIKQLQARVLAVERYLKDQQLMGIWGCSGKLICTTAVPWNTSWSNKSLDSIWN

SEQ ID NO: 3256 - protein, 56 aa, Human immunodeficiency virus 1; identical to SEQ ID NO: 3238

SEQ ID NO: 3257 - protein, 56 aa, Human immunodeficiency virus 1
RNRISIGPGRAFHTTKQIIGDIRQAHCNLSRATWEKTLEQIATKLRKQFRNKTIAF

SEQ ID NO: 3258 - protein, 56 aa, Human immunodeficiency virus 1
YRLKHLVWASRELERFALDPGLLETSEGCRKIIGQLQPSLQTGSEELKSLYNTIAV

SEQ ID NO: 3259 - protein, 46 aa, Human immunodeficiency virus 1
GQLKEALLDTGADDTVLEEINLPGRWKPKMIGGIGGFIKVRQYDEV

SEQ ID NO: 3260 - protein, 56 aa, Human immunodeficiency virus 1
MGNALRKGKFEGWAAVRERMRRTRTFPESEPCAPGVGQISRELAARGGIPSSHTPQ

SEQ ID NO: 3261 - protein, 56 aa, Human immunodeficiency virus 1
NAKIIIVQLVKPVNITCMRPNNNTRKSISIGPGRAFFATGDIIGDIRQAHCNVSRT

SEQ ID NO: 3262 - protein, 56 aa, Human immunodeficiency virus 1
EKNEQELLELDKWASLWNWFDISKWLWYIKIFIMIVGGLVGLRIVFTVLSIVNRVR

SEQ ID NO: 3263 - protein, 56 aa, Human immunodeficiency virus 1
QKQITKIQNFRVYYRDSRNPLWKGPAKLLWKGEGAVVIQDNSDIKVVPRRKAKIIR

SEQ ID NO: 3264 - protein, 56 aa, Human immunodeficiency virus 1
KLVSAGIRKILFLDGIDKAQDEHEKYHSNWRAMASDFNLPPVVAKEIVASCDKCQL

SEQ ID NO: 3265 - protein, 56 aa, Human immunodeficiency virus 1
LDGIDKAQEEHERYHSNWRAMASDFNLPPVVAKEIVASCDKCQLKGEAMHGQVDCS

SEQ ID NO: 3266 - protein, 56 aa, Human immunodeficiency virus 1
SIGPGRAFFATGDIIGDIRQAHCNVSRTEWNDTLSKVAAQLRKHFVNTSTDIIFAN

SEQ ID NO: 3267 - protein, 56 aa, Human immunodeficiency virus 1
LWQRPLVTIKIGGQLKEALLDTGADDTVLEEMSLPGRWKPKMIGGIGGFIKVRQYD

SEQ ID NO: 3268 - protein, 56 aa, Human immunodeficiency virus 1
VKCSNCGKEGHIARNCRAPRKKGCWKCGQEGHQMKDCTGRQANFLGKIWPSSKGRP

SEQ ID NO: 3269 - protein, 36 aa, Human immunodeficiency virus 1
SGVETTTPPQKQEPIDKELYPLTSLRSLFGNDPSSQ

SEQ ID NO: 3270 - protein, 56 aa, Human immunodeficiency virus 1
SGKLICTTNVPWNSSWSNKSLEEIWGNMTWMEWEKEVSNYSKEIYRLIEDSQNQQE

SEQ ID NO: 3271 - protein, 56 aa, Human immunodeficiency virus 1
YRLKHLVWASRELERFALNPDLLETADGCQQILGQLQPALKTGTEDLQSLYNTIAV

SEQ ID NO: 3272 - protein, 56 aa, Human immunodeficiency virus 1
MGGKWSKSSVIGWPAVRERMRRAEPAADGVGAASRDLEKHGAITSSNTAANNAACA

SEQ ID NO: 3273 - protein, 56 aa, Human immunodeficiency virus 1
MGGKWSKSSIVGWSTVRERMRKTPPAADGVGAVSQDLDKHGAVTSSNTAFNNPDCA

SEQ ID NO: 3274 - protein, 56 aa, Human immunodeficiency virus 1
MGGKWSKRRAEGWQTIRERMRRAEPAEPAADGVGAVSRDLARHGAITSSNTNNADI

SEQ ID NO: 3275 - protein, 56 aa, Human immunodeficiency virus 1
QDVKNWMTDTLLVQNANPDCKTILRALGPGASLEEMMTACQGVGGPGHKARVLAEA

SEQ ID NO: 3276 - protein, 56 aa, Human immunodeficiency virus 1
IRQGPKEPFRDYVDRFFKTLRAEQATQEVKGWMTDTLLVQNANPDCKTILKALGPG

SEQ ID NO: 3277 - protein, 56 aa, Human immunodeficiency virus 1
MGGKWSKRSVVGWPTVRERMRKTEPAADGVGAASRDLEKHGAITSSNTPANNADCA

SEQ ID NO: 3278 - protein, 56 aa, Human immunodeficiency virus 1
ILDIKQGPKEPFRDYVDRFYKTLRAEQATQEVKNWMTETLLVQNANPDCKQILKSL

SEQ ID NO: 3279 - protein, 56 aa, Human immunodeficiency virus 1
YRLKHLVWASRELERFALNPNLLETVEGCRQIIRQLQPSLQTGSEELRSLFNTVAT

SEQ ID NO: 3280 - protein, 56 aa, Human immunodeficiency virus 1
KCNNKTFNGTGPCNNVSTIQCTHGTKPVVSTQLLLNGSLAEEEIIIRSKNLTDNVK

SEQ ID NO: 3281 - protein, 56 aa, Human immunodeficiency virus 1
QKRIKCFNCGKEGHLARNCRAPRKKGCWKCGKEGHQMKDCTERQANFLGKIWPSHK

SEQ ID NO: 3282 - protein, 56 aa, Human immunodeficiency virus 1
YYRDSRDPIWKGPAKLLWKGEGAVVIQDNNEIKVVPRRKAKILKDYGKQMAGGDCV

SEQ ID NO: 3283 - protein, 56 aa, Human immunodeficiency virus 1
LYCVHQKIKIKDTKEALEKIEEEQNKSKKKAQQAAADTGNRGNSSQVSQNYPIVQN

SEQ ID NO: 3284 - protein, 56 aa, Human immunodeficiency virus 1
SADAAKEDTSARQAGQNYPIVSNAQGQMVHQAISPRTLNAWVKAVEEKAFNPEIIP

SEQ ID NO: 3285 - protein, 56 aa, Human immunodeficiency virus 1
YRLKHLVWASRELERFALNPGLLETGEGCQQIMEQLQSTLKTGSEEIKSLYNTVAT

SEQ ID NO: 3286 - protein, 56 aa, Human immunodeficiency virus 1
HKGIGGNEQVDKLVSAGVRKILFLDGIDKAQEEHEKYHNNWRAMASDFNLPPIVAK

SEQ ID NO: 3287 - protein, 56 aa, Human immunodeficiency virus 1
KDCTERQANFLGKIWPSHRGRPGNLLQNRTEPTAPPEESFRFGEETTTPSRKQETI

SEQ ID NO: 3288 - protein, 56 aa, Human immunodeficiency virus 1
ATQDVKNWMTETLLVQNANPDCKTILRALGQGASIEEMMTACQGVGGPSHKARVLA

SEQ ID NO: 3289 - protein, 56 aa, Human immunodeficiency virus 1
ATQDVKNWMTDTLLVQNANPDCKTILKALGSGATLEEMMTACQGVGGPGHKARVLA

SEQ ID NO: 3290 - protein, 56 aa, Human immunodeficiency virus 1
QMVHQAISPRTLNAWVKVIEEKAFSPEVIPMFSALSEGATPQDLNTMLNTVGGHQA

SEQ ID NO: 3291 - protein, 56 aa, Human immunodeficiency virus 1
YMMKHLVWASRELERFALDPGLLETSEGCKQIMKQLQPALQTGTKELISLHNTVAT

SEQ ID NO: 3292 - protein, 56 aa, Human immunodeficiency virus 1
RDKVQKEHALFYKHDVVPINNSTKDNIKNDNSTRYRLISCNTSVITQACPKISFEP

SEQ ID NO: 3293 - protein, 56 aa, Human immunodeficiency virus 1
YRLKHLVWASRELERFALNPGLLETPEGCLQIIEQIQPAIKTGTEELKSLFNLVAV

SEQ ID NO: 3294 - protein, 56 aa, Human immunodeficiency virus 1
LLLTRDGGINNSTNETFRPGGGDMRDNWRSELYKYKVVQIEPLGVAPTRAKRRVVE

SEQ ID NO: 3295 - protein, 56 aa, Human immunodeficiency virus 1
SENFTDNVKTIIVQLNETVKINCIRPNNKTRKRVTMGPGRVYYTTGEIIGDIRQAH

SEQ ID NO: 3296 - protein, 56 aa, Human immunodeficiency virus 1
IKCFNCGKEGHIAKNCRAPRKRGCWKCGKEGHQMKDCTERQANFLGKIWPSCKGRP

SEQ ID NO: 3297 - protein, 53 aa, Human immunodeficiency virus 1
YRKILRQRKIDRLIDRLIERAEDSGNESEGEISALVEMGVEMGHHAPWDVDDL

SEQ ID NO: 3298 - protein, 56 aa, Human immunodeficiency virus 1
STEETFRPGGGDMRDNWRSELYKYKTVKIKSLGVAPTRARRRVVEREKRAVGLGAV

SEQ ID NO: 3299 - protein, 56 aa, Human immunodeficiency virus 1
QKRIKCFNCGKEGHLARNCRAPRKKGCWKCGKEGHQMKDCTERQANFLRENLAFPQ

SEQ ID NO: 3300 - protein, 56 aa, Human immunodeficiency virus 1
DVKNWMTETLLVQNANPDCKTILKALGPQATLEEMMTACQGVGGPGHKARVLAEAM

SEQ ID NO: 3301 - protein, 30 aa, Human immunodeficiency virus 1
DSGNESGGDTEELETMVDMGHLRLLDGNDL

SEQ ID NO: 3302 - protein, 56 aa, Human immunodeficiency virus 1
KCFNCGKEGHIAKNCRAPRRKGCWKCGKEGHQLKDCTERQANFLGKIWPSHKGRPG

SEQ ID NO: 3303 - protein, 56 aa, Human immunodeficiency virus 1
NTSWSNKSFNEIWDNMTWMEWEREINNYTNLIYNLIEESQNQQEKNEQDLLALDKW

SEQ ID NO: 3304 - protein, 56 aa, Human immunodeficiency virus 1
MGGKWSKSRMGGWSTIRERMRRAEPVAEGVGAVSRDLDRRGAVTINNTASTNRDAA

SEQ ID NO: 3305 - protein, 56 aa, Human immunodeficiency virus 1
MGGKWSKRVTGWPTVRERMRRAEPAELAADGVGAASRDLEKHGALTSSNTAATNAD

SEQ ID NO: 3306 - protein, 56 aa, Human immunodeficiency virus 1
KSIRIGPGQAFYATGDIIGDIRRAYCNISGKQWNETLHKVITKLGSYFDNKTIILQ

SEQ ID NO: 3307 - protein, 56 aa, Human immunodeficiency virus 1
MGGKWSKSSIVGWPAIRERIRRTNPAADGVGAVSRDLEKHGAITSSNTASTNADCA

SEQ ID NO: 3308 - protein, 56 aa, Human immunodeficiency virus 1
MGGKWSKSSIVGWPAIRERMRRTPPTPPAAEGVGAVSQDLERRGAITSSNTRANNP

SEQ ID NO: 3309 - protein, 56 aa, Human immunodeficiency virus 1
SLIHSLIEESQNQQEKNEQELLELDKWASLWNWFNITNWLWYIKIFIMIVGGLVGL

SEQ ID NO: 3310 - protein, 56 aa, Human immunodeficiency virus 1
LLGVAPTKAKRRVVQREKRAVGIGAVFLGFLGAAGSTMGASMTLTVQARLLLSGIV

SEQ ID NO: 3311 - protein, 56 aa, Human immunodeficiency virus 1
ITGLLLTRDGGKDTDTNDTEIFRPGGGDMRDNWRSELYKYKVVTIEPLGVAPTKAK

SEQ ID NO: 3312 - protein, 56 aa, Human immunodeficiency virus 1
VQNAQGQMIHQAISPRTLNAWVKVIEEKAFSPEVIPMFSALSEGATPQDLNMMLNI

SEQ ID NO: 3313 - protein, 56 aa, Human immunodeficiency virus 1
RPNNHTRKRVTLGPGRVWYTTGEILGNIRQAHCNISRAQWNNTLQQIATTLREQFG

SEQ ID NO: 3314 - protein, 56 aa, Human immunodeficiency virus 1
YKLKHLVWASRELERFALNPGLLETTEGCRQIITQIQPSIQTGSEEIKSLYNTIAV

SEQ ID NO: 3315 - protein, 56 aa, Human immunodeficiency virus 1
TIKCFNCGKEGHIARNCRAPRKKGCWKCGQEGHQMKDCRNGKQANFLGKYWPPGGT

SEQ ID NO: 3316 - protein, 56 aa, Human immunodeficiency virus 1
TRDGGNNNETTDTEIFRPGGGNMRDNWRSELYKYKVVKIEPLGVAPTKAKRRVVQR

SEQ ID NO: 3317 - protein, 31 aa, Human immunodeficiency virus 1
QKQEKKQETIDKDLYPLASLKSLFGNDPLSQ

SEQ ID NO: 3318 - protein, 56 aa, Human immunodeficiency virus 1
KKTQQAAADSSQVSQNYPIVQNLQGQMVHQAISPRTLNAWVKVIEEKAFSPEVIPM

SEQ ID NO: 3319 - protein, 56 aa, Human immunodeficiency virus 1
VKTIIVQLNESVEINCTRPNNNTRKRITMGPGRVYYTTGQIIGDIRRAHCNLSRSK

SEQ ID NO: 3320 - protein, 56 aa, Human immunodeficiency virus 1
KLIRGTKSLTEVVPLSKEAELELEENREKLKEPVHGVYYQPDKDLWVSIQKHGEGQ

SEQ ID NO: 3321 - protein, 56 aa, Human immunodeficiency virus 1
NCGKQGHIAKNCRAPRKKGCWKCGKEGHQMKDCTERQANFLGKIWPSSKGRPGNFL

SEQ ID NO: 3322 - protein, 56 aa, Human immunodeficiency virus 1
LEESQNQQEKNEQELLELDKWASLWNWFSITNWLWYIKIFIMIVGGLVGLRIVFAV

SEQ ID NO: 3323 - protein, 56 aa, Human immunodeficiency virus 1
KCRDKEYNGTGPCKNVSTVQCTHGIKPVVSTQLLLNGSLAEEDIRIRSENFTDNTK

SEQ ID NO: 3324 - protein, 56 aa, Human immunodeficiency virus 1
MGARASVLSGGKLDAWEKIRLRPGGKKKYRLKHLVWASRELERFALNPGLLETGEG

SEQ ID NO: 3325 - protein, 56 aa, Human immunodeficiency virus 1; identical to SEQ ID NO: 3285

SEQ ID NO: 3326 - protein, 56 aa, Human immunodeficiency virus 1
LAEAMSQVTNASAAIMMQKGNFKGPRRTVKCSNCGKEGHIARNCRAPRKKGCWKCG

SEQ ID NO: 3327 - protein, 56 aa, Human immunodeficiency virus 1; identical to SEQ ID NO: 3312

SEQ ID NO: 3328 - protein, 56 aa, Human immunodeficiency virus 1
TKLGKAGHVTDKGKQKIITLTETTNQKAELHAIQLALQDSRPEVNIVTDSQYALGI

SEQ ID NO: 3329 - protein, 56 aa, Human immunodeficiency virus 1
AILKCNNKKFSGKGQCTNVSTVQCTHGIKPVVSTQLLLNGSLAEEEVVIRSDNFTN

SEQ ID NO: 3330 - protein, 56 aa, Human immunodeficiency virus 1
MGGKWSKSSVIGWPTVRERMRRAEPAADGVGAASQDLEKHGAITSSNTAATNADCA

SEQ ID NO: 3331 - protein, 56 aa, Human immunodeficiency virus 1
PKMIGGIGGFIKVKEYNNVTVEVQGKEVQGTVLVGPTPVNILGRNILTGLGCTLNF

SEQ ID NO: 3332 - protein, 56 aa, Human immunodeficiency virus 1
AMATAQQDLKGGYTAVFMQRGQNPIRKGTIKCFNCGKEGHIARNCRAPRKKGCWKC

SEQ ID NO: 3333 - protein, 56 aa, Human immunodeficiency virus 1
MGARASVLSGGELDRWEKIRLRPGGKKKYKLKHIVWASRELERFAVNPGLLETSEG

SEQ ID NO: 3334 - protein, 56 aa, Human immunodeficiency virus 1
MGGKWSKRMSGWSAVRERMKRAEPAEPAADGVGAVSRDLEKHGAITSSNTAANNAD

SEQ ID NO: 3335 - protein, 56 aa, Human immunodeficiency virus 1
HIGPGRAFYATGEIIGDTRKAHCNISEKQWYDTLIKIATEFKDQYNKTVGFQPSAG

SEQ ID NO: 3336 - protein, 56 aa, Human immunodeficiency virus 1
YRLKHLVWASRELERYACNPGLLETAEGTEQLLQQLEPALKTGSEDLKSLWNAIAV

SEQ ID NO: 3337 - protein, 56 aa, Human immunodeficiency virus 1
YKLKHVVWASRELERFAINPGLLETSEGCRQILGQLQPSLQTGSEERKSLYNTVAT

SEQ ID NO: 3338 - protein, 56 aa, Human immunodeficiency virus 1
VWGIKQLQARVLAVERYLKDQQLLGIWGCSGKLICTTAVPWNASWSNKSLDQIWNN

SEQ ID NO: 3339 - protein, 56 aa, Human immunodeficiency virus 1
ASWSNKSLEQIWNNMTWMEWDREINNYTSLIHSLIEESQNQQEKNEQELLELDKWA

SEQ ID NO: 3340 - protein, 56 aa, Human immunodeficiency virus 1
DKKFNGTGPCTNVSTVQCTHGIKPVVSTQLLLNGSLAEGEVVIRSENFTNNAKTII

SEQ ID NO: 3341 - protein, 56 aa, Human immunodeficiency virus 1
IHMGPGKAFYTTGDIIGDIRQAHCNISGEKWNMTLSRVKEKLKEHFKNGTITFKPP

SEQ ID NO: 3342 - protein, 56 aa, Human immunodeficiency virus 1
MGGKWSKSSIVGWPAIRERIRAAEGVGAVSQDLDKRGAITNSNTGATNADLAWLEA

SEQ ID NO: 3343 - protein, 56 aa, Human immunodeficiency virus 1
IDGKEILRPIGGDMRDNWRSELYKYKVVRIEPVGVAPTKAKRRVVQRAKRAVGMGA

SEQ ID NO: 3344 - protein, 56 aa, Human immunodeficiency virus 1; identical to SEQ ID NO: 3204

SEQ ID NO: 3345 - protein, 56 aa, Human immunodeficiency virus 1
LLNGSLAEEQIIIRTKNISDNTKNIIVQLKTPVNITCTRPNNNTRTSIHLGPGRAF

SEQ ID NO: 3346 - protein, 56 aa, Human immunodeficiency virus 1
QMVHQAISPRTLNAWVKVVEEKAFSPEVIPMFSALSEGATPQDLNTMLNTVGGHQA

SEQ ID NO: 3347 - protein, 56 aa, Human immunodeficiency virus 1
EAMSQVTNTNTAIMMQKGNFKGQRKFVKCFNCGKEGHIARNCRAPRKKGCWKCGRE

SEQ ID NO: 3348 - protein, 56 aa, Human immunodeficiency virus 1
LLLTRDGGKNTTNGIEIFRPAGGDMRDNWRSELYKYKVVKIEPLGVAPTKARRRVV

SEQ ID NO: 3349 - protein, 56 aa, Human immunodeficiency virus 1
WSNKSLDEIWDNMTWMEWDKQINNYTDEIYRLLEVSQNQQEKNEQDLLALDKWANL

SEQ ID NO: 3350 - protein, 56 aa, Human immunodeficiency virus 1
EIFRPGGGDMRDNWRSELYKYKVVKIEPLGVAPTKAKRRVVQREKRAVGMLGAMFL

SEQ ID NO: 3351 - protein, 56 aa, Human immunodeficiency virus 1
YRLKHLVWASRELERFALNPGLLETSDGCKQIIGQLQPAIRTGSEELRSLFNTVAT

SEQ ID NO: 3352 - protein, 56 aa, Human immunodeficiency virus 1
QRTQQAPAAADKEKDSKISQNYPIVQNAQGQMVHQAISPRTLNAWVKVVEEKAFSP

SEQ ID NO: 3353 - protein, 56 aa, Human immunodeficiency virus 1
CFNCGKEGHIARNCRAPRKKGCWKCGREGHQMKDCTERQANFLGKIWPSSKGRPGN

SEQ ID NO: 3354 - protein, 56 aa, Human immunodeficiency virus 1
MGGKWSKSSIVGWPQIRERIRQTPVAAEGVGAVSQDLARHGAITSSNTATNNPDCA

SEQ ID NO: 3355 - protein, 56 aa, Human immunodeficiency virus 1
MGARASVLSGGELDRWEKIRLRPGGKKKYKLKHVVWASRELERFAINPGLLETSEG

SEQ ID NO: 3356 - protein, 56 aa, Human immunodeficiency virus 1
THGIKPVVSTQLLLNGSLAEEEIMIRSENLTDNTKNIIVQLNETVTINCTRPGNNT

SEQ ID NO: 3357 - protein, 30 aa, Human immunodeficiency virus 1
DSGNESDGDTEELSTMVDMGNLRLLDVNDL

SEQ ID NO: 3358 - protein, 56 aa, Human immunodeficiency virus 1
IIVQLNESVEITCTRPSNNTRESIRIGPGQTFYATGDIIGDIRQAHCNISEEKWNK

SEQ ID NO: 3359 - protein, 56 aa, Human immunodeficiency virus 1
LLLTRDGGTNVTNDTEVFRPGGGDMRDNWRSELYKYKVIKIEPLGIAPTKAKRRVV

SEQ ID NO: 3360 - protein, 56 aa, Human immunodeficiency virus 1
THNETFRPGGGDMRDNWRSELYKYKVVQIEPLGIAPTRARRRVVQREKRAVGLGAV

SEQ ID NO: 3361 - protein, 56 aa, Human immunodeficiency virus 1
QALSPRTLNAWVKVIEEKAFSPEVIPMFTALSEGATPQDLNTMLNTVGGHQAAMQM

SEQ ID NO: 3362 - protein, 56 aa, Human immunodeficiency virus 1
TGLLLTRDGGNSSSREEIFRPGGGNMRDNWRSELYKYKVVKIEPLGVAPTKAKRRV

SEQ ID NO: 3363 - protein, 56 aa, Human immunodeficiency virus 1
IISSQPTQSDSPIVQQIIEELTKKERVYLTWVPAHKGIGGNEKIDKLVSKDIRRVL

SEQ ID NO: 3364 - protein, 56 aa, Human immunodeficiency virus 1
CTRPNNNTRKSITKGPGRVIYATGQIIGDIRKAHCNLSRAQWNNTLKQVVTKLREQ

SEQ ID NO: 3365 - protein, 56 aa, Human immunodeficiency virus 1
LYCVHQRIEVRDTKEALDKIEEEQNKSKKKAQQAAADTGNSSQVSQNYPIVQNLQG

SEQ ID NO: 3366 - protein, 56 aa, Human immunodeficiency virus 1
GNMKDNWRSELYKYKVVEIEPLGVAPTKAKRQVVQREKRAAGLGALFLGFLGDSRE

SEQ ID NO: 3367 - protein, 56 aa, Human immunodeficiency virus 1
LYCVHKGIDVKDTKEALEKMEEEQNKSKKKAQQAAADTGNNSQVSQNYPIVQNLQG

SEQ ID NO: 3368 - protein, 56 aa, Human immunodeficiency virus 1
ATNTTSSGGEKMEKGEMKNCSFNITTSIRDKVQKEHALFYKHDVVPINNSTKDNIK

SEQ ID NO: 3369 - protein, 56 aa, Human immunodeficiency virus 1
LYCVHEKIDVRDTKEALDKIKEEQNKSQQKTQQAEAADKGKVSQNYPIVQNLQGQM

SEQ ID NO: 3370 - protein, 56 aa, Human immunodeficiency virus 1
LTWVPAHKGIGGNEKIDKLVSKDIRRVLFLEGIDQAQEDHEKYHSNWRALASDFGL

SEQ ID NO: 3371 - protein, 56 aa, Human immunodeficiency virus 1
LKDTINEEAAEWDRLHPTQAGPIPPGQIREPRGSDIAGTTSTLQEQIQWMTGNPPV

SEQ ID NO: 3372 - protein, 56 aa, Human immunodeficiency virus 1
QLQSRVLAIERYLKDQQLLGIWGCSGKLICTTNVPWNTSWSNKSYNEIWDNMTWLE

SEQ ID NO: 3373 - protein, 56 aa, Human immunodeficiency virus 1
QPVHQALSPRTLNAWVKVIEEKAFSPEVIPMFSALSEGATPQDLNTMLNTIGGHQA

SEQ ID NO: 3374 - protein, 56 aa, Human immunodeficiency virus 1
QASQEVKGWMTETLLVQNANPDCKTILKALGPQATLEEMMTACQGVGGPSHKARVL

SEQ ID NO: 3375 - protein, 56 aa, Human immunodeficiency virus 1
PIKCFNCGKEGHIAKNCRAPRKRGCWKCGQEGHQMKDCKNGRQANFLGKYWPPGGT

SEQ ID NO: 3376 - protein, 56 aa, Human immunodeficiency virus 1
TQEVKNWMTETLLVQNSNPDCKQILKALGPEATLEEMMVACQGVGGPTHKAKILAE

SEQ ID NO: 3377 - protein, 56 aa, Human immunodeficiency virus 1
MGGKWSKSSIVGWPNVRERMRAAEGVGKVSQDLDKHGAITSSNTRATNADLAWLEA

SEQ ID NO: 3378 - protein, 56 aa, Human immunodeficiency virus 1
YMLKHLVWANRELEKFALNPDLLDTSAGCKQIIKQLQPALQTGTEELKSLFNTVAT

SEQ ID NO: 3379 - protein, 56 aa, Human immunodeficiency virus 1
YKVVKIEPLGVAPTKAKRRVVQREKRAVTLGAMFLGFLGAAGSTMGARSLTLTVQA

SEQ ID NO: 3380 - protein, 56 aa, Human immunodeficiency virus 1; identical to SEQ ID NO: 3378

SEQ ID NO: 3381 - protein, 56 aa, Human immunodeficiency virus 1
IYPGIKVRQLCKLLRGTKALTEVIPLTEEAELELAENREILKEPVHGVYYDPSKDL

SEQ ID NO: 3382 - protein, 56 aa, Human immunodeficiency virus 1
EAMSQVTNTNIMMQRGNFRDHKRIVKCFNCGKQGHIAKNCRAPRKKGCWKCGKEGH

SEQ ID NO: 3383 - protein, 56 aa, Human immunodeficiency virus 1
PAGFAILKCNDKKFNGTEICKNVSTVQCTHGIKPVVSTQLLLNGSLAEEEIMIRSE

SEQ ID NO: 3384 - protein, 56 aa, Human immunodeficiency virus 1
MGGTMSKCSPVGWPAIRERIRRAAPAAEGVGAASRDLDKYGALTSSNTPANNPDCA

SEQ ID NO: 3385 - protein, 56 aa, Human immunodeficiency virus 1
KARVLAEAMSQATNSTAAIMMQRGNFKGQKRIKCFNCGKEGHLARNCRAPRKKGCW

SEQ ID NO: 3386 - protein, 56 aa, Human immunodeficiency virus 1
APTRAKRRVVQREKRAVGTIGAMFLGFLGAAGSTMGAGSITLTVQARHLLSGIVQQ

SEQ ID NO: 3387 - protein, 56 aa, Human immunodeficiency virus 1
MGARASVLSGGKLDAWEKIRLRPGGKKKYRLKHLVWASRELERFALNPGLLETSDG

SEQ ID NO: 3388 - protein, 56 aa, Human immunodeficiency virus 1
DINGTSLKEDQGEIKNCSFNVTTELKDKKRKQQALFYRLDVEPIKNSSNIYKLISC

SEQ ID NO: 3389 - protein, 56 aa, Human immunodeficiency virus 1
SSNWKEMDRGEIKNCSFKVTTSIRNKMQKEYALFYKLDVVPIDNDNTSYKLINCNT

SEQ ID NO: 3390 - protein, 56 aa, Human immunodeficiency virus 1
PIKCFNCGKEGHIAKNCRAPRKRGCWKCGQEGHQMKDCKNGRQANFFREVLASGGH

SEQ ID NO: 3391 - protein, 56 aa, Human immunodeficiency virus 1
QKTQQAAAAQQAAAATKNSSSVSQNYPIVQNAQGQMIHQAISPRTLNAWVKVIEEK

SEQ ID NO: 3392 - protein, 56 aa, Human immunodeficiency virus 1
MGGRWSKSSIVGWPAIRERIRRTDPAADGVGAVSRDLEKHGAITSSNTRGTNADCA

SEQ ID NO: 3393 - protein, 45 aa, Human immunodeficiency virus 1
RAPEDSQTHQVSLPKQPAPQFRGDPTGPKESKKKVERETETHPVD

SEQ ID NO: 3394 - protein, 56 aa, Human immunodeficiency virus 1
DNAKTIIVQLNESVVINCTRPNNNTRRRLSIGPGRAFYARRNIIGDIRQAHCNISR

SEQ ID NO: 3395 - protein, 56 aa, Human immunodeficiency virus 1
TAVPWNASWSNKSLEEIWDNMTWMEWEREIDNYTSLIYTLIEESQNQQEKNEQELL

SEQ ID NO: 3396 - protein, 56 aa, Human immunodeficiency virus 1
MGGKWSKSSIVGWPEVRERIRNTPTAAEGVGAVSQDLDRHGAITSSNTAANNPDCA

SEQ ID NO: 3397 - protein, 56 aa, Human immunodeficiency virus 1
SNSGKMMEGGEMKNCSFNITTSIRDKMQKEYALFYKLDIVPIDNDKTNTRYRLISC

SEQ ID NO: 3398 - protein, 56 aa, Human immunodeficiency virus 1
QSLSPRTLNAWVKVIEEKAFSPEVIPMFSALSEGATPQDLNTMLNTVGGHQAAMQM

SEQ ID NO: 3399 - protein, 56 aa, Human immunodeficiency virus 1
NMTWMEWEKEIENYTNTIYTLIEESQIQQEKNEQELLELDKWASLWNWFGITKWLW

SEQ ID NO: 3400 - protein, 56 aa, Human immunodeficiency virus 1; identical to SEQ ID NO: 3385

SEQ ID NO: 3401 - protein, 29 aa, Human immunodeficiency virus 1
PSQKQEQKDKELYPLASLKSLFGNDQLSQ

SEQ ID NO: 3402 - protein, 56 aa, Human immunodeficiency virus 1
RIEPVGVAPTKAKRRVVQRAKRAVGMGAVLFGFLGAAGSTMGAAAITLTAQARQLL

SEQ ID NO: 3403 - protein, 56 aa, Human immunodeficiency virus 1
SWSNKSQEEIWNNMTWMEWEKEISNYSNIIYKLIEESQNQQEKNEQELLALDKWAS

SEQ ID NO: 3404 - protein, 56 aa, Human immunodeficiency virus 1
TKNIIVQFNRSVIIDCRRPNNNTRKGIRIGPGQTFFATGEIIGDIRKAYCNINRTL

SEQ ID NO: 3405 - protein, 56 aa, Human immunodeficiency virus 1
ERILGTYLGRSAEPVPLQLPPLERLTLDCNEDCGTSGTQGVGSPQILVESPTVLES

SEQ ID NO: 3406 - protein, 56 aa, Human immunodeficiency virus 1
LGIWGCSGKLICTTAVPWNASWSNKSLSDIWDNMTWMEWEREIDNYTNLIYSLIED

SEQ ID NO: 3407 - protein, 56 aa, Human immunodeficiency virus 1
NATSTVVSPAEIKNCSFNITTEIKDKKKKESALFYRLDVLPLNGEGNNSSTEYRLI

SEQ ID NO: 3408 - protein, 56 aa, Human immunodeficiency virus 1
SLEDIWDNMTWMQWEREIDNYTNTIYTLLEESQNQQEKNEQELLELDKWASLWNWF

SEQ ID NO: 3409 - protein, 56 aa, Human immunodeficiency virus 1
SAEAAKEETSPRQTSQNYPIVTNAQGQMVHQAISPRTLNAWVKAVEEKAFNPEIIP

SEQ ID NO: 3410 - protein, 49 aa, Human immunodeficiency virus 1
SRPEPTAPPAESFGFGEEITPSQKQEQKDKELYPLASLKSLFGNDPSSQ

SEQ ID NO: 3411 - protein, 56 aa, Human immunodeficiency virus 1
MGARASVLTGSKLDAWERIRLRPGSKKAYRLKHLVWASRELERYACNPGLLETAEG

SEQ ID NO: 3412 - protein, 56 aa, Human immunodeficiency virus 1
IEESQTQQEKNEQELLELDKWASLWNWFNITQWLWYIKIFIMIVGGLIGLRIVFAV

SEQ ID NO: 3413 - protein, 56 aa, Human immunodeficiency virus 1
HIGPGRAFYTGEIRGNIRQAHCNISRAKWNNTLKQIVEKLREQFKNKTIVFNHSSG

SEQ ID NO: 3414 - protein, 56 aa, Human immunodeficiency virus 1
LYCVHERIEVKDTKEAVEKMEEEQNKSKKKTQQAAADSSQVSQNYPIVQNLQGQMV

SEQ ID NO: 3415 - protein, 56 aa, Human immunodeficiency virus 1
IPIHYCAPAGFAIIKCNDKKFNGTGPCTNVSTVQCTHGIKPVVSTQLLLNGSLAEE

SEQ ID NO: 3416 - protein, 56 aa, Human immunodeficiency virus 1
SSSWETMEKGEIKNCSFNITTSIRDKVQKEYALFYNLDVVPIDNASYRLISCNTSV

SEQ ID NO: 3417 - protein, 56 aa, Human immunodeficiency virus 1
QMVHQSLSPRTLNAWVKVIEEKAFSPEVIPMFSALSEGATPQDLNTMLNTVGGHQA

SEQ ID NO: 3418 - protein, 56 aa, Human immunodeficiency virus 1
ATLEEMMTACQGVGGPSHKARVLAEAMSQANSAIMMQKSNFKGQRRVVKCFNCGKE

SEQ ID NO: 3419 - protein, 56 aa, Human immunodeficiency virus 1
TNLIYNLIEESQNQQEKNEQDLLALDKWDSLWNWFSITKWLWYIKIFIMIVGGLVG

SEQ ID NO: 3420 - protein, 56 aa, Human immunodeficiency virus 1
NFSGNGSCTNVSTVQCTHGIKPVISTQLILNGSLNTDGIVIRNDSHSNLLVQWNET

SEQ ID NO: 3421 - protein, 56 aa, Human immunodeficiency virus 1
KPVVSTQLLLNGSLAEEKMIIRSENISDNTKTIIVQFKNPVKINCTRPNNNTRRSI

SEQ ID NO: 3422 - protein, 56 aa, Human immunodeficiency virus 1
ILNGSLNTDGIVIRNDSHSNLLVQWNETVPINCTRPGNNTGGQVQIGPAMTFYNIE

SEQ ID NO: 3423 - protein, 56 aa, Human immunodeficiency virus 1
VQCTHGIKPVVSTQLLLNGSLAEEEIIIRSEDITKNTKNIIVQLNEAVEINCTRPS

SEQ ID NO: 3424 - protein, 56 aa, Human immunodeficiency virus 1
YRLKHIVWASRKLERFAVNPGLLETSKGCRQILGQLQPSLQTGSEELRSLYNTVAT

SEQ ID NO: 3425 - protein, 56 aa, Human immunodeficiency virus 1; identical to SEQ ID NO: 3336

SEQ ID NO: 3426 - protein, 56 aa, Human immunodeficiency virus 1
MGARASVLSGGKLDAWEKIRLRPGGKKKYKLKHLVWASRELERFALNPGLLETTEG

SEQ ID NO: 3427 - protein, 45 aa, Human immunodeficiency virus 1
RAPQDSQTHQASLSKQPASQSRGDPTGPTESKKKVERETETDPFD

SEQ ID NO: 3428 - protein, 56 aa, Human immunodeficiency virus 1
TNQKTELQAIHLALQDSGSEVNIVTDSQYALGIIQAQPDKSESEIVNQIIEQLIQK

SEQ ID NO: 3429 - protein, 46 aa, Human immunodeficiency virus 1
KIKLQEKIEQIRQKIRDRTEDRGKESDGDAEWLAILLSPDKLDNWV

SEQ ID NO: 3430 - protein, 56 aa, Human immunodeficiency virus 1
KESWTVNDIQKLVGKLNWASQIYPGIKVKQLCKLLRGAKALTDIVPLTAEAELELA

SEQ ID NO: 3431 - protein, 56 aa, Human immunodeficiency virus 1
IEESQNQQEKNEQELLELDKWAGLWSWFSITNWLWYIRIFIIIVGGLVGLRIVFAV

SEQ ID NO: 3432 - protein, 56 aa, Human immunodeficiency virus 1
KVKKEYALFNRLDVVPIENTNNTKYRLISCNTSVITQACPKVSFQPIPIHYCVPAG

SEQ ID NO: 3433 - protein, 56 aa, Human immunodeficiency virus 1
TIAYIEYRKLLRQRRIDRLIKRTRERAEDSGNESDGDTEELSTMVDMGNLRLLDVN

SEQ ID NO: 3434 - protein, 56 aa, Human immunodeficiency virus 1
LYCVHRKIDVKDTKEALDKIEEIQNKSQQKTQQAAADKEKDNKVSQNYPIVQNAQG

SEQ ID NO: 3435 - protein, 56 aa, Human immunodeficiency virus 1
AMQMLKDTINEEAAEWDRVHPVHAGPIPPGQMREPRGSDIAGTTSTLQEQIAWMTG

SEQ ID NO: 3436 - protein, 56 aa, Human immunodeficiency virus 1
LYCVHERIEVKDTKEALEKMEEEQNKSKNKKAQQAAADAGNNSQVSQNYPIVQNLQ

SEQ ID NO: 3437 - protein, 56 aa, Human immunodeficiency virus 1
VKNWMTETLLVQNANPDCRTILKALGSGATLEEMMTACQGVGGPGHKARVLAEAMS

SEQ ID NO: 3438 - protein, 56 aa, Human immunodeficiency virus 1
NFTNNAKIIIVQLNKSVEINCTRPNNNTRNRISIGPGRAFHTTKQIIGDIRQAHCN

SEQ ID NO: 3439 - protein, 56 aa, Human immunodeficiency virus 1
SSEGMMERGEIKNCSFNITKSIRDKVQKEYALFYKLDVVPIDNKNNTKYRLISCNT

SEQ ID NO: 3440 - protein, 56 aa, Human immunodeficiency virus 1
ANNTVENKEEIKNCSFKITTERGGKKKEEYALFYKLDVVPISNGNKTSYRLIHCNV

SEQ ID NO: 3441 - protein, 56 aa, Human immunodeficiency virus 1
KQKKEYALFYKLDVVQINNSNTSYRLINCNTSTLTQACPKVSFDPIPIHYCAPAGF

SEQ ID NO: 3442 - protein, 56 aa, Human immunodeficiency virus 1
DIWDNMTWMEWEREIDNYTNLIYSLIEDSQIQQEKNEKELLELDKWASLWNWFNIT

SEQ ID NO: 3443 - protein, 56 aa, Human immunodeficiency virus 1
NNTTLAPNVTISEEMKNCSFNITTEIRDKQKKEYALFYKLDVVQINNSNTSYRLIN

SEQ ID NO: 3444 - protein, 56 aa, Human immunodeficiency virus 1
SQIQQEKNEKELLELDKWASLWNWFNITNWLWYIKIFIMIVGGLIGLRIVFAVLSI

SEQ ID NO: 3445 - protein, 56 aa, Human immunodeficiency virus 1
ISNYLGRPAEPVPLQLPPLERLTLDCNEDCGTSGTQGVGSPQILVESPTILESGTK

SEQ ID NO: 3446 - protein, 56 aa, Human immunodeficiency virus 1
GKEGHLARNCRAPRKKGCWKCGKEGHQMKDCTERQANFLGRLWPSNKGRPGNFLQS

SEQ ID NO: 3447 - protein, 56 aa, Human immunodeficiency virus 1
NVSTVQCTHGIKPVVSTQLLLNGSLAEEEVVIRSENFTDNAKTIIVQLKEPVVINC

SEQ ID NO: 3448 - protein, 56 aa, Human immunodeficiency virus 1
MGGKWSKSSIVGWPKIRERIRRTPPTETGVGAVSQDAVSQDLDKCGAAASSSPAAN

SEQ ID NO: 3449 - protein, 56 aa, Human immunodeficiency virus 1
KTILKALGPGATLEEMMTACQGVGGPSHKARVLAEAMSQATNSTAAIMMQRGNFKG

SEQ ID NO: 3450 - protein, 56 aa, Human immunodeficiency virus 1
QALSPRTLNAWVKVIEEKAFSPEVIPMFSALSEGATPQDLNTMLNTVGGHQAAMQM

SEQ ID NO: 3451 - protein, 56 aa, Human immunodeficiency virus 1
YCAPAGFAILKCNNNTCNGTGPCTNVSTVQCTHGIKPVVSTQLLLNGSLAEEEIII

SEQ ID NO: 3452 - protein, 56 aa, Human immunodeficiency virus 1
SALSEGATPQDLNTMLNTVGGHQAAMQMLKDTINEEAAEWDRMHPVQAGPIPPGQI

SEQ ID NO: 3453 - protein, 56 aa, Human immunodeficiency virus 1
IRQGPKEPFRDYVDRFFRVLRAEQATQEVKNWMTETLLVQNANPDCRTILKALGSG

SEQ ID NO: 3454 - protein, 56 aa, Human immunodeficiency virus 1
QMLKDTINEEAAEWDRLHPVHAGPVAPGQMRDPRGSDIAGTTSTLQEQIAWMTGNP

SEQ ID NO: 3455 - protein, 56 aa, Human immunodeficiency virus 1
LKEPVHGVYHDPSKELIAEVQKQGPDQWTYQIYQEPYKNLKTGKYAKRGSAHTNDV

SEQ ID NO: 3456 - protein, 56 aa, Human immunodeficiency virus 1
QGQMVHQAISPRTLNAWVKVVEEKAFSPEVIPMFSALSEGATPQDLNAMLNTVGGH

SEQ ID NO: 3457 - protein, 56 aa, Human immunodeficiency virus 1
AKAYEKESHNVWATHACVPSDPSPQELVLGNVTENFNMWKNKMVEQMHEDIISLWD

SEQ ID NO: 3458 - protein, 56 aa, Human immunodeficiency virus 1
VSQDLDKRGAITNSNTGATNADLAWLEAQEEEVGFPVRPQVPLRPMTYKAALDLSH

SEQ ID NO: 3459 - protein, 56 aa, Human immunodeficiency virus 1
CFNCGKEGHLARNCRAPRKKGCWKCGKEGHQMKECTERQANFLRENLAFQQGEARK

SEQ ID NO: 3460 - protein, 56 aa, Human immunodeficiency virus 1
MGGKWSKCSMKGWPTIRERMKRAELQPPEPAAEGVGAASRDLEKHGAITSSNTAAT

SEQ ID NO: 3461 - protein, 56 aa, Human immunodeficiency virus 1; identical to SEQ ID NO: 3391

SEQ ID NO: 3462 - protein, 56 aa, Human immunodeficiency virus 1
GKWKPKMIGGIGGFIKVRQYDQILIEICGKKAIGTILVGPTPVNIIGRNMLTQIGC

SEQ ID NO: 3463 - protein, 56 aa, Human immunodeficiency virus 1
QKTQQAEAADKGKVSQNYPIVQNLQGQMVHQPISARTLNAWVKVVEEKAFSPEVIP

SEQ ID NO: 3464 - protein, 56 aa, Human immunodeficiency virus 1
NKSLDDIWNNMTWMQWEREIDNYTSLIYSLLEKSQTQQEKNEQELLELDKWASLWN

SEQ ID NO: 3465 - protein, 56 aa, Human immunodeficiency virus 1
MGGKWSKSSIVGWPAVGERMRQTPTAAEGVGAVSRDLDRRGAITSSNTRTTNPDLA

SEQ ID NO: 3466 - protein, 56 aa, Human immunodeficiency virus 1
PAHKGIGGNEQVDKLVSSGIRKVLFLDGIDKAQEDHEKYHSNWRAMASDFNLPPVV

SEQ ID NO: 3467 - protein, 56 aa, Human immunodeficiency virus 1
RDKVQKEYALFYKLDVVPIDNDNNSTNTCYRLISCDTSVITQACPKVSFEPIPIHY

SEQ ID NO: 3468 - protein, 56 aa, Human immunodeficiency virus 1
VPWNASWSNKSLNMIWNNMTWMQWEREIDNYTGIIYNLLEESQNQQEKNEQELLEL

SEQ ID NO: 3469 - protein, 56 aa, Human immunodeficiency virus 1
NGTGPCKNVSTVQCTHGIKPVVSTQLLLNGSLAEEGIVIRSQNISNNAKTIIVHLN

SEQ ID NO: 3470 - protein, 56 aa, Human immunodeficiency virus 1; identical to SEQ ID NO: 3382

SEQ ID NO: 3471 - protein, 56 aa, Human immunodeficiency virus 1
TQKKYALFYKLDVVPIEKGNISPKNNTSNNTSYGNYTLIHCNSSVITQACPKVSFE

SEQ ID NO: 3472 - protein, 56 aa, Human immunodeficiency virus 1
TSSSGGTMMENGEIKNCSFQVTTSRRDKTQKKYALFYKLDVVPIEKGNISPKNNTS

SEQ ID NO: 3473 - protein, 56 aa, Human immunodeficiency virus 1
AKSYEKEAHNVWATHACVPTDPNPQEVVLENVTERFNMWENNMVEQMHTDIISLWD

SEQ ID NO: 3474 - protein, 56 aa, Human immunodeficiency virus 1
MGNAWSKSKFAGWSEVRDRMRRSSSDPQQPCAPGVGAVSRELATRGGISSSHTPQN

SEQ ID NO: 3475 - protein, 56 aa, Human immunodeficiency virus 1
KSMDQIWNNMTWMEWEREIDNYTSLIYNLIEESQNQQEKNEQELLELDKWASLWNW

SEQ ID NO: 3476 - protein, 56 aa, Human immunodeficiency virus 1
VKGWMTDTLLVQNANPDCKTILKALGTGATLEEMMTACQGVGGPSHKARVLAEAMS

SEQ ID NO: 3477 - protein, 56 aa, Human immunodeficiency virus 1
MEPVDPRLEPWKHPGSQPKTACNNCYCKKCCYHCQVCFLTKGLGISYGRKKRRQRR

SEQ ID NO: 3478 - protein, 32 aa, Human immunodeficiency virus 1
CSEDCGTSGTQGVGSPQILVESPAVLESGTKE

SEQ ID NO: 3479 - protein, 56 aa, Human immunodeficiency virus 1
KNEQELLALDKWASLWNWFDITQWLWYIKIFIMIVGGLIGLRIVFTVLSIVNRVRK

SEQ ID NO: 3480 - protein, 56 aa, Human immunodeficiency virus 1
NNSSGGTVEKEEIKNCSFNITTGIRDKVQKAYAYFYKLDVVPIDDDNTNTSYRLIH

SEQ ID NO: 3481 - protein, 56 aa, Human immunodeficiency virus 1
QMVHQAISPRTLNAWVKVIEEKAFSPEVIPMFAALSEGATPQDLNTMLNTVGGHQA

SEQ ID NO: 3482 - protein, 56 aa, Human immunodeficiency virus 1
CRQILGQLQPSLQTGSEERKSLYNTVATLYCVHQKIKIKDTKEALEKIEEEQNKSK

SEQ ID NO: 3483 - protein, 56 aa, Human immunodeficiency virus 1
YRIKHLVWASRELDRFALNPGLLESAKGCQQILVQLQPALQTGTQEIKSLYNTVAT

SEQ ID NO: 3484 - protein, 56 aa, Human immunodeficiency virus 1
LLDTGADDTVLEDINLPGKWKPKMIGGIGGFIKVKQYDNILIEICGHKAIGTVLVG

SEQ ID NO: 3485 - protein, 56 aa, Human immunodeficiency virus 1
MGGKWSKSKMGWPAVRERMKRAEPAADGVGAASRDLEKHGALTSSNTAATNADCAW

SEQ ID NO: 3486 - protein, 56 aa, Human immunodeficiency virus 1
VGAASRDLEKHGALTSSNTAATNADCAWLEAQEDEEVGFPVKPQVPLRPMTYKAAL

SEQ ID NO: 3487 - protein, 56 aa, Human immunodeficiency virus 1
TRDGGGDKNSTTEIFRPAGGNMKDNWRSELYKYKVVKIEPLGVAPTKAKRRVVQRE

SEQ ID NO: 3488 - protein, 56 aa, Human immunodeficiency virus 1
KAKRRVVQREKRAVGIGALFLGFLGAAGSTMGARSMTLTVQARQLLSGIVQQQNNL

SEQ ID NO: 3489 - protein, 45 aa, Human immunodeficiency virus 1
RAPQDSQTHQVSLPKQPASQARGDPTGPKESKKKVERETETDPVD

SEQ ID NO: 3490 - protein, 32 aa, Human immunodeficiency virus 1; identical to SEQ ID NO: 3478

SEQ ID NO: 3491 - protein, 48 aa, Human immunodeficiency virus 1
RTEPTAPPEESFRFGEETTTPSRKQETIDKELPLTSLKSLFGSDPLST

SEQ ID NO: 3492 - protein, 56 aa, Human immunodeficiency virus 1
DNWRSELYKYKVVKIEPLGVAPTKAKRRVVAREKRAIGMGAFFLGFLGAAGSTMGA

SEQ ID NO: 3493 - protein, 56 aa, Human immunodeficiency virus 1
FAILKCKDKRFNGTGPCKNVSTVQCTHGIKPVVSTQLLLNGSLAEEEIIIRSENIT

SEQ ID NO: 3494 - protein, 56 aa, Human immunodeficiency virus 1
YRLKHLVWASRELEKFTLNPGLLETAEGCQQILGQLQPALQTGTEELRSLYNTVAV

SEQ ID NO: 3495 - protein, 56 aa, Human immunodeficiency virus 1
ITGILLTRDGVGNNTSNETFRPGGGDMRDNWRSELYKYKVVKIEPLGVAPTKAKRR

SEQ ID NO: 3496 - protein, 56 aa, Human immunodeficiency virus 1
VVEIKPLGVAPTKPKRRVVEREKRAALGALFLGFLGAAGSTMGAASITLTVQARQL

SEQ ID NO: 3497 - protein, 56 aa, Human immunodeficiency virus 1
IDIIATDIQTRELQKQITKIQNFRVYYRDSRDPIWKGPAKLPWKGEGAVVIQDNSE

SEQ ID NO: 3498 - protein, 56 aa, Human immunodeficiency virus 1
QALSPRTLNAWVKVVEDKAFSPEVIPMFSALSEGATPQDLNMMLNVVGGHQAAMQM

SEQ ID NO: 3499 - protein, 56 aa, Human immunodeficiency virus 1
TFNGTGLCTNVSTVQCTHGIRPVVSTQLLLNGSLAEEQIIIRTKNISDNTKNIIVQ

SEQ ID NO: 3500 - protein, 56 aa, Human immunodeficiency virus 1
STDINIGEIQEQRNCSFNVTTAIRDKNQKVHALFYRADIVQIDEGERNKSDNHYRL

SEQ ID NO: 3501 - protein, 56 aa, Human immunodeficiency virus 1
SLNDIWQNMTWMEWEREIDNYTGLIYRLIEESQTQQEKNEQELLELDKWASLWNWF

SEQ ID NO: 3502 - protein, 56 aa, Human immunodeficiency virus 1
NWRSELYKYKVVKIEPLGVAPTKAKRRVVEREKRAIGLGAMFLGFLGAAGSTMGAA

SEQ ID NO: 3503 - protein, 56 aa, Human immunodeficiency virus 1
QVQQTSIMMQRGNFRGPRRIKCFNCGKEGHLAKNCRAPRKKGCWKCGKEGHQMKDC

SEQ ID NO: 3504 - protein, 56 aa, Human immunodeficiency virus 1
AKAYDTEVHNVWATHACVPTDPNPQEVVLGNVTENFNMWKNNMVDQMHEDIISLWD

SEQ ID NO: 3505 - protein, 56 aa, Human immunodeficiency virus 1
MQMLKDTINDEAAEWDRIHPQQAGPIPPGQIREPSGSDIAGTTSTLQEQIRWMTSN

SEQ ID NO: 3506 - protein, 56 aa, Human immunodeficiency virus 1
PMFSALSEGATPQDLNTMLNTVGGHQAAMQMLKDTINDEAAEWDRIHPQQAGPIPP

SEQ ID NO: 3507 - protein, 56 aa, Human immunodeficiency virus 1
ALGPQATLEEMMTACQGVGGPSHKARVLAEAMSQATNSAAAVMMQRGNFKGPRKTI

SEQ ID NO: 3508 - protein, 56 aa, Human immunodeficiency virus 1
EAMSQVTNTATIMMQRGNFRNQRKMVKCFNCGKEGHTARNCRAPRKKGCWKCGKEG

SEQ ID NO: 3509 - protein, 56 aa, Human immunodeficiency virus 1
IWENMTWMQWEKEISNHTSTIYRLIEESQIQQEKNEQDLLALDKWASLWNWFDISN

SEQ ID NO: 3510 - protein, 56 aa, Human immunodeficiency virus 1
LQLTVWGIKQLRARVLAVERYLRDQQLLGIWGCSGKLICTTNVPWNSSWSNKSQSE

SEQ ID NO: 3511 - protein, 56 aa, Human immunodeficiency virus 1
YKLKHIVWASRELGRFALNRDLLETAEGCVQIMKQLQPALTGTEELRSLFNTVATL

SEQ ID NO: 3512 - protein, 56 aa, Human immunodeficiency virus 1
MGARASILSGGKLDDWEKIRLRPGGKKKYRIKHLVWASRELDRFALNPGLLESAKG

SEQ ID NO: 3513 - protein, 56 aa, Human immunodeficiency virus 1
AMSQASGAAAAAIMMQKSNFKGPRRIIKCFNCGKEGHLARNCRAPRKKGCWKCGKE

SEQ ID NO: 3514 - protein, 47 aa, Human immunodeficiency virus 1
LWKGEGAVVIQDNSDIKVVPRRKAKIIRDYGKQMAGDDCVASRQDED

SEQ ID NO: 3515 - protein, 56 aa, Human immunodeficiency virus 1
QIQQEKNEQDLLALDKWASLWNWFDISNWLWYIKIFIMIVGGLIGLRIVFTVLSVV

SEQ ID NO: 3516 - protein, 56 aa, Human immunodeficiency virus 1
LKDTINEEAAEWDRLHPVHAGPIPPGQMREPRGSDIAGTTSTVQEQIGWMTGNPPI

SEQ ID NO: 3517 - protein, 56 aa, Human immunodeficiency virus 1
MGARASVLTGGKLDQWESIYLRPGGKKKYRMKHLVWASRELERFACNPGLMDTADG

SEQ ID NO: 3518 - protein, 56 aa, Human immunodeficiency virus 1
IAEIQKQGQGQWTYQIYQEPFKNLKTGKYARMRGAHTNDVKQLTEAVQKITTESIV

SEQ ID NO: 3519 - protein, 56 aa, Human immunodeficiency virus 1; identical to SEQ ID NO: 3373

SEQ ID NO: 3520 - protein, 56 aa, Human immunodeficiency virus 1
LENVTEDFNMWKNNMVEQMQEDVINLWDQSLKPCVKLTPLCVTLNCKDVNATNTTS

SEQ ID NO: 3521 - protein, 56 aa, Human immunodeficiency virus 1
GQMVHQAISPRTLNAWVKVIEEKAFSPEVIPMFSALSEGATPQDLNTMLNTVGGHQ

SEQ ID NO: 3522 - protein, 56 aa, Human immunodeficiency virus 1; identical to SEQ ID NO: 3512

SEQ ID NO: 3523 - protein, 56 aa, Human immunodeficiency virus 1
LYKYKVVKIEPLGVAPTKAKRQVVQREKRAVGMGAMFLGFLGAAGSTMGAASITLT

SEQ ID NO: 3524 - protein, 56 aa, Human immunodeficiency virus 1
CRQILGQLQPSLQTGSEELRSLYNTVATLYCVHQRIEIKDTKEALDKIEEEQNKSK

SEQ ID NO: 3525 - protein, 56 aa, Human immunodeficiency virus 1
KKAQQAAADTGHSSQVSQNYPIVQNIQGQMVHQAISPRTLNAWVKVVEEKAFSPEV

SEQ ID NO: 3526 - protein, 56 aa, Human immunodeficiency virus 1; identical to SEQ ID NO: 3289

SEQ ID NO: 3527 - protein, 56 aa, Human immunodeficiency virus 1; identical to SEQ ID NO: 3525

SEQ ID NO: 3528 - protein, 56 aa, Human immunodeficiency virus 1
LQSRPEPTAPPFLQSRPEPTAPPEESFRSGVETTTPPQKQEPIDKELYPLTSLRSL

SEQ ID NO: 3529 - protein, 56 aa, Human immunodeficiency virus 1
KYKVVKIEPLGVAPTKAKRRVVQREKRAVGIGALFLGFLGAAGSTMGARSMTLTVQ

SEQ ID NO: 3530 - protein, 56 aa, Human immunodeficiency virus 1
KALGPGATLEEMMTACQGVGGPAHKARVLAEAMSQVQQPTTSVFAQRGNFKGIRKP

SEQ ID NO: 3531 - protein, 56 aa, Human immunodeficiency virus 1
FDCFSDSAIRKAILGQRVSPRCNYQAGHNKVGSLQYLALTALITPKKIKPPLPSVR

SEQ ID NO: 3532 - protein, 56 aa, Human immunodeficiency virus 1
MGARASVLSGGKLDAWEKIRLRPGGKKKYRLKHIVWASRELKRFALNPGLLETTEG

SEQ ID NO: 3533 - protein, 56 aa, Human immunodeficiency virus 1
FNCGKEGHTARNCRAPRKKGCWKCGKEGHQMKDCTERQANFLGKIWPSYKGRPGNF

SEQ ID NO: 3534 - protein, 56 aa, Human immunodeficiency virus 1
LYCVHQRIDVKDTKEALDKIEEIQNKSRQKTQQAAAAQQAAAATKNSSSVSQNYPI

SEQ ID NO: 3535 - protein, 56 aa, Human immunodeficiency virus 1
VIIVQLNNSIEINCIRPNNNTRKSIPIGPGQAFYATGDIIGDIRQAHCNVSRIKWR

SEQ ID NO: 3536 - protein, 45 aa, Human immunodeficiency virus 1
RTPQSSKSHQDLIPEQPLSQQQGDQTGQKKQKEALESKTEADPCD

SEQ ID NO: 3537 - protein, 32 aa, Human immunodeficiency virus 1
CNEDCGTSGTQGVGSPQILVESPTVLESGTKE

SEQ ID NO: 3538 - protein, 56 aa, Human immunodeficiency virus 1
YSPLSFQTLVPNPRGPDRPEGTEEGGGEQDRDRSVRLVNGFLPVVWDDLRSLSLFS

SEQ ID NO: 3539 - protein, 56 aa, Human immunodeficiency virus 1
EPAAEGVGAASRDLEKHGAITSSNTAATNADCAWLEAQEDEEVGFPVRPQVPLRPM

SEQ ID NO: 3540 - protein, 56 aa, Human immunodeficiency virus 1
NADKLWVTVYYGVPVWKEATPTLFCASDAKAYEKEVHNVWATHACVPTDPNPQEVE

SEQ ID NO: 3541 - protein, 56 aa, Human immunodeficiency virus 1
RKTQQEAADKGVSQNYPIVQNLQGQMVHQALSPRTLNAWVKVIEEKAFSPEVIPMF

SEQ ID NO: 3542 - protein, 56 aa, Human immunodeficiency virus 1
VVKIEPLGIAPTKTRRRVVEREKRAVGMGASFLGFLGAAGSTMGAASITLTVQARQ

SEQ ID NO: 3543 - protein, 56 aa, Human immunodeficiency virus 1
AKAYEKEVHNVWATHACVPTDPNPQEVEMENVTENFNMWKNNMVEQMHTDIISLWD

SEQ ID NO: 3544 - protein, 56 aa, Human immunodeficiency virus 1
AANRETKKGKAGYVTDRGRQKVVSLTETTNQKTELQAIHLALQDSGSEVNIVTDSQ

SEQ ID NO: 3545 - protein, 56 aa, Human immunodeficiency virus 1
IKPVVSTQLLLNGSLAEEEIIIRSENITDNTKNIIVQLNETVQINCTRPNNNTRKS

SEQ ID NO: 3546 - protein, 56 aa, Human immunodeficiency virus 1
ESQTQQEKNEKELLELDKWASLWNWFSITQWLWYIKIFIMIIGGLIGLRIVFAVLS

SEQ ID NO: 3547 - protein, 56 aa, Human immunodeficiency virus 1
GHLAKNCRAPRKKGCWKCGKEGHQMKDCTERQANFLGKIWPSNKGRPGNFPQSRPE

SEQ ID NO: 3548 - protein, 46 aa, Human immunodeficiency virus 1
RPPKSSKDHQDPIPEQPLSRQQPGDQTGQKKQKKALEGKTEADPCD

SEQ ID NO: 3549 - protein, 52 aa, Human immunodeficiency virus 1
FLQSRPEPTAPPAESFGFGEEMTPSPKQEQLKDKEPPLASLRSLFGSDPLLQ

SEQ ID NO: 3550 - protein, 56 aa, Human immunodeficiency virus 1
KCCYHCQMCFLKKGLGISYGRKKRSQRHRTPASLQDHQNSISKQPLSRTHGDPTGP

SEQ ID NO: 3551 - protein, 56 aa, Human immunodeficiency virus 1
ITGLILTRDGGNSSDNSDNETLRPGGGDMRDNWISELYKYKVVRIEPLGVAPTKAK

SEQ ID NO: 3552 - protein, 56 aa, Human immunodeficiency virus 1
MRDNWISELYKYKVVRIEPLGVAPTKAKRRVVEREKRAIGLGAMFLGFLGAAGSTM

SEQ ID NO: 3553 - protein, 45 aa, Human immunodeficiency virus 1
RAPQDSKTHQVSLSKQPASQPRGDPTGPKESKKKVERETETDPED

SEQ ID NO: 3554 - protein, 56 aa, Human immunodeficiency virus 1
SNRSLDDIWNNMTWMQWEKEISNYTGIIYNLIEESQIQQEKNEKELLELDKWASLW

SEQ ID NO: 3555 - protein, 56 aa, Human immunodeficiency virus 1
QKTQQAAADKEKDNKVSQNYPIVQNAQGQMVHQAISPRTLNAWVKVVEEKAFSPEV

SEQ ID NO: 3556 - protein, 56 aa, Human immunodeficiency virus 1
YNLIEESQIQQEKNEKELLELDKWASLWNWFSISKWLWYIRIFIIVVGGLIGLRII

SEQ ID NO: 3557 - protein, 56 aa, Human immunodeficiency virus 1
EVIPMFSALSEGATPQDLNAMLNTVGGHQAAMQMLKDTINEEAAEWDRLHPVHAGP

SEQ ID NO: 3558 - protein, 56 aa, Human immunodeficiency virus 1
SELYKYKVVKIEPLGVAPTKAKRRVVQREKRAVGLGALFLGFLGAAGSTMGAASLT

SEQ ID NO: 3559 - protein, 56 aa, Human immunodeficiency virus 1
SALSEGATPQDLNTMLNTVGGHQAAMQMLKDTINEEAAEWDRLHPTQAGPIPPGQI

SEQ ID NO: 3560 - protein, 56 aa, Human immunodeficiency virus 1
IERYLRDQQILSLWGCSGKTICYTTVPWNETWSNNTSYDTIWNNLTWQQWDEKVRN

SEQ ID NO: 3561 - protein, 56 aa, Human immunodeficiency virus 1
LGIPHPAGLKKKKSVTVLDVGDAYFSVPLDKDFKKYTAFTIPSVNNETPGIRYQYN

SEQ ID NO: 3562 - protein, 56 aa, Human immunodeficiency virus 1
EICLEMEKEGKISKIGPENPYNTPVFAIKKKDSSKWRKLVDFKELNKRTQDFWEVQ

SEQ ID NO: 3563 - protein, 56 aa, Human immunodeficiency virus 1
PTPVNIIGRNMLTQIGCTLNFPVSPIETVPVKLKPGMDGPKVKQWPLTEEKIKALT

SEQ ID NO: 3564 - protein, 40 aa, Human immunodeficiency virus 1
HPMSQHGMEDEDKEVLKWEFDSRLALRHIARERHPEYYQD

SEQ ID NO: 3565 - protein, 29 aa, Human immunodeficiency virus 1
DCGTSGTQGVGSPQILVESPTILESGTKE

SEQ ID NO: 3566 - protein, 17 aa, Human immunodeficiency virus 1
MGGKWSKRSVVGWPAVR

SEQ ID NO: 3567 - protein, 56 aa, Human immunodeficiency virus 1
VPSLSFPQITLWQRPLVTIKIGGQIKEALLDTGADDTVLEDINLPGKWKPKMIGGI

SEQ ID NO: 3568 - protein, 56 aa, Human immunodeficiency virus 1
QANSAIMMQKSNFKGQRRVVKCFNCGKEGHIARNCRAPRKKGCWKCGREGHQMKDC

SEQ ID NO: 3569 - protein, 56 aa, Human immunodeficiency virus 1
MGGRWSKSSIVGWPAIRERIRRTDPRRTDPAADGVGAASRDLEKHGAITSSNTRDT

SEQ ID NO: 3570 - protein, 56 aa, Human immunodeficiency virus 1
DQSLKPCVKLTPLCVTLNCHDFNATNATSNSGKMMEGGEMKNCSFNITTSIRDKMQ

SEQ ID NO: 3571 - protein, 56 aa, Human immunodeficiency virus 1
GRPGNFLQSRPEPTAPPAESFGFGEEIKPSQKQEQKDKELYPLASLKSLFGNDQLS

SEQ ID NO: 3572 - protein, 56 aa, Human immunodeficiency virus 1
LYWVHQSIQVRDTKEALDKLEEEQNRTQQKTQQGKADKGVSQNYPIVQNLQGQMVH

SEQ ID NO: 3573 - protein, 56 aa, Human immunodeficiency virus 1
QKTQQGKADKGVSQNYPIVQNLQGQMVHQALSPRTLNAWVKVIEEKAFSPEVIPMF

SEQ ID NO: 3574 - protein, 56 aa, Human immunodeficiency virus 1
AKRQVVQREKRAAGLGALFLGFLGDSREHMGAASITLTVQARQLLSGIVQQQNNLL

SEQ ID NO: 3575 - protein, 56 aa, Human immunodeficiency virus 1
EGHIAKNCRAPRKKGCWKCGREGHQMKDCTERQANFLGKIWPSNKGRPGNFIQNRP

SEQ ID NO: 3576 - protein, 56 aa, Human immunodeficiency virus 1
LKDTINEEAAEWDRMHPVQAGPIPPGQIREPRGSDIAGTTSTLQEQITWMTSNPPI

SEQ ID NO: 3577 - protein, 56 aa, Human immunodeficiency virus 1; identical to SEQ ID NO: 3534

SEQ ID NO: 3578 - protein, 56 aa, Human immunodeficiency virus 1
ATLEEMMTACQGVGGPSHKARVLAEAMSQATNTAIMMQKSNFKGQRRIVKCFNCGK

SEQ ID NO: 3579 - protein, 56 aa, Human immunodeficiency virus 1
KRKQQALFYRLDVEPIKNSSNIYKLISCNMSTVTQACPKVSFDPIPIHYCAPAGYA

SEQ ID NO: 3580 - protein, 56 aa, Human immunodeficiency virus 1
VSQDLDKHGAITSSNTRATNADLAWLEAQEEEVGFPVRPQVPLRPMTYKAAVDLSH

SEQ ID NO: 3581 - protein, 56 aa, Human immunodeficiency virus 1
KVHALFYRADIVQIDEGERNKSDNHYRLINCNTSVIKQACPKVSFEPIPIHYCAPA

SEQ ID NO: 3582 - protein, 56 aa, Human immunodeficiency virus 1
GPEATLEEMMVACQGVGGPTHKAKILAEAMASAQQDLKGGYTAVFMQRGQNPNRKG

SEQ ID NO: 3583 - protein, 56 aa, Human immunodeficiency virus 1
QKTQQAGAADRGKDSQNYPIVQNMQGQMVHQPISARTLNAWVKVVEEKAFSPEVIP

SEQ ID NO: 3584 - protein, 56 aa, Human immunodeficiency virus 1
NTPPLVKLWYQLEKEPIAGVETFYVDGAANRETKIGKAGYVTDRGRQKIVSLTETT

SEQ ID NO: 3585 - protein, 56 aa, Human immunodeficiency virus 1
AKAYDTEVHNVWATQACVPTDPNPQEVELVNVTENFNMWKNNMVEQMHEDIISLWD

SEQ ID NO: 3586 - protein, 56 aa, Human immunodeficiency virus 1
TDNMGGEIKNCSFNMTTEVRDKREKVHALFYRLDIVPLKNESSNTSGDYRLINCNT

SEQ ID NO: 3587 - protein, 56 aa, Human immunodeficiency virus 1
VHQAISPRTLNAWVKAVEEKAFNPEIIPMFMALSEGAVPYDINTMLNAIGGHQGAL

SEQ ID NO: 3588 - protein, 56 aa, Human immunodeficiency virus 1
VLAEAMSQVTNSATIMMQRGNFRNQRKIIKCFNCGKEGHIAKNCRAPRKRGCWKCG

SEQ ID NO: 3589 - protein, 56 aa, Human immunodeficiency virus 1; identical to SEQ ID NO: 3411

SEQ ID NO: 3590 - protein, 56 aa, Human immunodeficiency virus 1
MSQVNNTTIMMQKSNFKGPKRAIKCFNCGKEGHLARNCRAPRKKGCWKCGKEGHQM

SEQ ID NO: 3591 - protein, 56 aa, Human immunodeficiency virus 1
KTIIGGGEVKNCSFNITTSIRDKVHKEYALFYKLDVVPIKSNNDSSTYTRYRLIHC

SEQ ID NO: 3592 - protein, 56 aa, Human immunodeficiency virus 1
LIEESQTQQEINERDLLALDKWANLWNWFDISNWLWYIKIFIMIVGGLIGLRIVFA

SEQ ID NO: 3593 - protein, 50 aa, Human immunodeficiency virus 1
RPGNYVQRPAHPSAPPMEEEVKGQENQEQKGGPNELYPFASLKSLFGTDQ

SEQ ID NO: 3594 - protein, 56 aa, Human immunodeficiency virus 1
AMASAQQDLKGGYTAVFMQRGQNPNRKGPIKCFNCGKEGHIAKNCRAPRKRGCWKC

SEQ ID NO: 3595 - protein, 56 aa, Human immunodeficiency virus 1
DDIWNNMTWMEWEREIDNYTDYIYDLLEKSQTQQEKNEKELLELDKWASLWNWFDI

SEQ ID NO: 3596 - protein, 56 aa, Human immunodeficiency virus 1
NTTNNNSSIEEKMKGEIKNCSFNVTTNIRDKVQKEYALFYKLDVVPIDNDNNSTNT

SEQ ID NO: 3597 - protein, 56 aa, Human immunodeficiency virus 1
GNFPQSRTEPTAPPEESFRFGEETTTPYQKQEKKQETIDKDLYPLASLKSLFGNDP

SEQ ID NO: 3598 - protein, 56 aa, Human immunodeficiency virus 1
MGNKWSKCSTVGRPAIRERMRRAPAAEGVGPASQDSDKYGALTSSSTPANNADCAW

SEQ ID NO: 3599 - protein, 56 aa, Human immunodeficiency virus 1
TSIRDKVQREYALFYKLDVEPIDDNKNTTNNTKYRLINCNTSVITQACPKVSFEPI

SEQ ID NO: 3600 - protein, 56 aa, Human immunodeficiency virus 1
MGARASVLSGGKLDTWERIRLRPGGKKKYALKHLIWASRELERFTLNPGLLETSEG

SEQ ID NO: 3601 - protein, 56 aa, Human immunodeficiency virus 1
SQNQQEKNEQELLELDKWASLWNWFSITNWLWYIRIFIMIVGGLIGLRIIFAVLSI

SEQ ID NO: 3602 - protein, 56 aa, Human immunodeficiency virus 1
NNMTWMQWDREISNYTNTIYRLLEDSQNQQEKNEQDLLALDKWQNLWTWFGITNWL

SEQ ID NO: 3603 - protein, 56 aa, Human immunodeficiency virus 1
KKAQQAAADTGNSSQVSQNYPIVQNLQGQMVHQAISPRTLNAWVKVIEEKAFSPEV

SEQ ID NO: 3604 - protein, 56 aa, Human immunodeficiency virus 1
TIAYIEYRKLVRQRRIDWLVKRIKERAEDSGNESGGDTEELETMVDMGHLRLLDGN

SEQ ID NO: 3605 - protein, 56 aa, Human immunodeficiency virus 1
MSKVNNTNIMMQRSNCKGPKRTIKCFNCGKEGHLARNCRAPRKKGCWKCGKEGHQV

SEQ ID NO: 3606 - protein, 56 aa, Human immunodeficiency virus 1
CKQIMKQLQPALQTGTKELISLHNTVATLYCVHEKIDVRDTKEALDKIKEEQNKSQ

SEQ ID NO: 3607 - protein, 56 aa, Human immunodeficiency virus 1
KVVKIEPIGVAPTKARRRVVEREKRAIGLGAVFLGFLGAAGSTMGAASVTLTVQAR

SEQ ID NO: 3608 - protein, 56 aa, Human immunodeficiency virus 1; identical to SEQ ID NO: 3454

SEQ ID NO: 3609 - protein, 56 aa, Human immunodeficiency virus 1
KSQSDIWDKMTWLEWDKEVSNYTQVIYNLIEESQTQQEINERDLLALDKWANLWNW

SEQ ID NO: 3610 - protein, 56 aa, Human immunodeficiency virus 1
AMQMLKETINEEAAEWDRLHPVHAGPIAPGQMREPRGSDIAGTTSTLQEQIGWMTN

SEQ ID NO: 3611 - protein, 56 aa, Human immunodeficiency virus 1
LGVAPTKAKRRVVQREKRAVGMLGAMFLGFLGAAGSTMGATSMALTVQARQLLSGI

SEQ ID NO: 3612 - protein, 56 aa, Human immunodeficiency virus 1; identical to SEQ ID NO: 3587

SEQ ID NO: 3613 - protein, 56 aa, Human immunodeficiency virus 1; identical to SEQ ID NO: 3594

SEQ ID NO: 3614 - protein, 56 aa, Human immunodeficiency virus 1
ELYKYKVVKIEPLGVAPTKAKRRVVQREKRAVGVIGAMFLGFLGAAGSTMGAASIT

SEQ ID NO: 3615 - protein, 46 aa, Human immunodeficiency virus 1
DKGDIKVVPRRKAKIIRDYGKQMAGTDSMANRQTESESMEQPGEIP

SEQ ID NO: 3616 - protein, 56 aa, Human immunodeficiency virus 1
QMLKDTINEEAAEWDRLHPVHAGPVAPGQMREPRGSDIAGTTSTLQEQITWMTNNP

SEQ ID NO: 3617 - protein, 56 aa, Human immunodeficiency virus 1; identical to SEQ ID NO: 3376

SEQ ID NO: 3618 - protein, 56 aa, Human immunodeficiency virus 1
MFTALSEGATPQDLNTMLNTVGGHQAAMQMLKDTINEEAAEWDRLHPVHAGPVAPG

SEQ ID NO: 3619 - protein, 56 aa, Human immunodeficiency virus 1
DMRDNWRSELYKYKVVKIEPLGVAPTEARRRVVEREKRAVGMGAFFLGFLGAAGST

SEQ ID NO: 3620 - protein, 56 aa, Human immunodeficiency virus 1
NNSINSANDEMKNCSFNITTELRDKKRKAYALFYKLDIVPLNNGSTDYRLINCNTS

SEQ ID NO: 3621 - protein, 56 aa, Human herpesvirus 3; identical to SEQ ID NO: 10

SEQ ID NO: 3622 - protein, 56 aa, Human herpesvirus 3
AVAPTSAATRKPDPAVAPTSAATRKPDPAVAPTSAASRKPDPAVASTSAATRKPDP

SEQ ID NO: 3623 - protein, 56 aa, Human herpesvirus 3
PDPAVAPTSAATRKPDPAVAPTSAASRKPDPAVAPTSAATRKPDPAVAPTSAASRK

SEQ ID NO: 3624 - protein, 56 aa, Human herpesvirus 3
VSITELYTSAATRKPDPAVAPTSAASRKPDPAVAPTSAASRKPDPAVAPTSAASRK

SEQ ID NO: 3625 - protein, 56 aa, Human herpesvirus 3
AVAPTSAASRKPDPAVAPTSAASRKPDPAVAPTSAASRKPDPAVAPTSAASRKPDP

SEQ ID NO: 3626 - protein, 56 aa, Human herpesvirus 3
AVAPTSAASRKPDPAVASTSAATRKPDPAVAPTSAATRKPDPAVAPTSAATRKPDP

SEQ ID NO: 3627 - protein, 56 aa, Human herpesvirus 3
TELYTSAASRKPDPAVAPTSAASRKPDPAVAPTSAATRKPDPAVAPTSAATRKPDP

SEQ ID NO: 3628 - protein, 56 aa, Human herpesvirus 3
AVAPTSAATRKPDPAVAPTSAATRKPDPAVAPTSAAIRKPDPAVAPTSAASRKPDP

SEQ ID NO: 3629 - protein, 56 aa, Human herpesvirus 3
PDPAVAPTSAATRKPDPAVAPTSAASRKPDPAANTQHSQPPFLYENIQCVHGGIQS

SEQ ID NO: 3630 - protein, 56 aa, Human herpesvirus 3
QTVQPAQPAQPVQPAQPVQPAQPAQTVQPAQPAQPVQPAQPAQPAQPVQPAQPAQP

SEQ ID NO: 3631 - protein, 56 aa, Human herpesvirus 3
AVAPTSAAIRKPDPAVAPTSAASRKPDPAVAPTSAASRKPDPAVAPTSAASRKPDP

SEQ ID NO: 3632 - protein, 56 aa, Human herpesvirus 3
QPAQTVQPAQPVQPAQPVQPAQPVQPVQPAQPVQPAQPAQPAQPAQPAQTVQPAQP

SEQ ID NO: 3633 - protein, 56 aa, Human herpesvirus 3
AQPAQPAQTVQPAQTVQPAQTVQPAQPAQPVQPAQPVQPAQPVQPAQPVQPAQPVQ

SEQ ID NO: 3634 - protein, 39 aa, Human herpesvirus 3
AQGVPQSTPPPTQNTPQGGKGQTLSHTGQSGNASRSRRV

SEQ ID NO: 3635 - protein, 56 aa, Human herpesvirus 3
VQPAQPVQPAQPVQPVQPAQPVQPAQPAQTVQPAQPAQPVQPAQPVQPAQPAQTVQ

SEQ ID NO: 3636 - protein, 56 aa, Human herpesvirus 3
QPVQPAQPVQPAQPVQPAQPVQPAQPVQPAQPVQPAQPIEPGTQIVVQNFKKPQSV

SEQ ID NO: 3637 - protein, 56 aa, Human herpesvirus 3
EKPNATDTPIEEIGDSQNTEPSVNSGFDPDKFREAQEMIKYMTLVSAAERQESKAR

SEQ ID NO: 3638 - protein, 56 aa, Human herpesvirus 3
PAQPAQPVQPAQPAQPAQPVQPAQPAQPAQPVQPAQPVQPAQPVQPAQPVQPAQPI

SEQ ID NO: 3639 - protein, 56 aa, Human herpesvirus 3
VHEGLNLIQAANEADLGEGASVSKRGHNRKTGDLQGGMGNEPMYAQVRKPKSRTDT

SEQ ID NO: 3640 - protein, 56 aa, Human herpesvirus 3
AQPAQTVQPAQPAQTVQPAQPAQPAQPAQPAQTVQPAQPVQPAQPVQPAQPVQPVQ

SEQ ID NO: 3641 - protein, 56 aa, Human herpesvirus 3
PLFKSPVQVVRSSKCKKMPVRPAQPAQPAQPAQPAQTVQPAQTVQPAQTVQPAQPA

SEQ ID NO: 3642 - protein, 56 aa, Human herpesvirus 3
PAQPVQPAQPAQPAQPAQPAQTVQPAQPVQPAQPVQPAQPVQPVQPAQPVQPAQPA

SEQ ID NO: 3643 - protein, 56 aa, Human herpesvirus 3
AVAPTSAASRKPDPAVAPTSAASRKPDPAVAPTSAATRKPDPAANTQHSQPPFLYE

SEQ ID NO: 3644 - protein, 53 aa, Human herpesvirus 3
TVALNSEFFEDFDFDENVTEDADKSTQRRPRVIDVTPKRKPSGKSSHSKCAKC

SEQ ID NO: 3645 - protein, 50 aa, Human herpesvirus 3
RKTGDLQGGMGNEPMYAQVRKPKSRTDTQTTGRITNRSRARSASRTDTRK

SEQ ID NO: 3646 - protein, 56 aa, Human herpesvirus 3
RNDYDGFLENAHEHHGVYNQGRGIDSGERLMQPTQMSAQEDLGDDTGIHVIPTLNG

SEQ ID NO: 3647 - protein, 56 aa, Human herpesvirus 3
PLFKSPVQVVRSSKCKKMPVRPAQPAQPAQPAQTVQPAQPAQTVQPAQPAQPAQPA

SEQ ID NO: 3648 - protein, 56 aa, Human herpesvirus 3
PDKFREAQEMIKYMTLVSAAERQESKARKKNKTSALLTSRLTGLALRNRRGYSRVR

SEQ ID NO: 3649 - protein, 56 aa, Human herpesvirus 3
RASVLRYDDFHTDEDKLDTNSVYEPYYHSDHAESSWVNRGESSRKAYDHNSPYIWP

SEQ ID NO: 3650 - protein, 56 aa, Human herpesvirus 3
MNDVDATDTFVGQGKFRGAISTSPSHIMQTCGFIQQMFPVEMSPGIESEDDPNYDV

SEQ ID NO: 3651 - protein, 56 aa, Human herpesvirus 3
SDHAESSWVNRGESSRKAYDHNSPYIWPRNDYDGFLENAHEHHGVYNQGRGIDSGE

SEQ ID NO: 3652 - protein, 56 aa, Human herpesvirus 3
AKRMRVKAYRVDKSPYNQSMYYAGLPVDDFEDSESTDTEEEFGNAIGGSHGGSSYT

SEQ ID NO: 3653 - protein, 56 aa, Human herpesvirus 3
RLMQPTQMSAQEDLGDDTGIHVIPTLNGDDRHKIVNVDQRQYGDVFKGDLNPKPQG

SEQ ID NO: 3654 - protein, 56 aa, Human herpesvirus 3
EEETGTLDIQAVDWMYQARNIIDSHPLSVRIDGTGPLHTYKDRVDKLYALRTKLDL

SEQ ID NO: 3655 - protein, 46 aa, Human herpesvirus 3
RPNTKTRRGIQNATPESDVMLEAAIAQLATIREESPPHSVVNPFVK

SEQ ID NO: 3656 - protein, 56 aa, Human herpesvirus 3
VVSGSSGQQPQQGAQSSTVQPTTGSPPAAQGVPQSTPPPTQNTPQGGKGQTLSHTG

SEQ ID NO: 3657 - protein, 56 aa, Human herpesvirus 3
SRTPIIPPVSGPLMMPDGSPWPGSAPLPSNRVRFGPSGETREGHWEDEAVRAARAR

SEQ ID NO: 3658 - protein, 56 aa, Human herpesvirus 3
NPSMSLGISGPTILPQKTQSADQSALQQPAALAFSGSSPQHPPPQTTSASVGQQQH

SEQ ID NO: 3659 - protein, 56 aa, Human herpesvirus 3
YENPLSVEKPSRSFTKNAAVKPKLEDSPKRAPPGAGAIASGRPISFSTAPKTATSS

SEQ ID NO: 3660 - protein, 56 aa, Human herpesvirus 3
DSCEPSHDTTSNVLNISGSNISGSTVPGLKRPPEDDELFDLSGIPIKHGNITMEMI

SEQ ID NO: 3661 - protein, 56 aa, Human herpesvirus 3
LKTSPMKALYPLTTKGLKQLPEGMDPFAEKPNATDTPIEEIGDSQNTEPSVNSGFD

SEQ ID NO: 3662 - protein, 56 aa, Human herpesvirus 3
SNRVRFGPSGETREGHWEDEAVRAARARYEASTEPVPLYVPELGDPARQYRALINL

SEQ ID NO: 3663 - protein, 56 aa, Human herpesvirus 3
DDRHKIVNVDQRQYGDVFKGDLNPKPQGQRLIEVSVEENHPFTLRAPIQRIYGVRY

SEQ ID NO: 3664 - protein, 56 aa, Human herpesvirus 3
VKVPLPARKPGGPVPGPVEQLYHVLSDSVPAKGAKADLPFETDDTRPRKHDARGIT

SEQ ID NO: 3665 - protein, 56 aa, Human herpesvirus 3
TPVADARVADDHVVSKAKRRVSEPVTITSGPVVDPPAVITMPLDGPAPNGGFRRIP

SEQ ID NO: 3666 - protein, 56 aa, Human herpesvirus 3
MGQSSSSGRGGICGLCKRYNELVTCNGETVALNSEFFEDFDFDENVTEDADKSTQR

SEQ ID NO: 3667 - protein, 56 aa, Human herpesvirus 3
EDAIDDEGEAEEDAIDDEGEAEEDAIDDEGEAEEDYFSVSQVCSRDADEVYFTLDP

SEQ ID NO: 3668 - protein, 56 aa, Human herpesvirus 3
NGSEQNTSTSRHENRIFKLTEREANEEININTDAIDDEGEAEEGEAEEDAIDDEGE

SEQ ID NO: 3669 - protein, 56 aa, Human herpesvirus 3
AQPAQPAQTVQPAQPIEPGTQIVVQNFKKPQSVKTTLSQKDIPLYVETESETAVLI

SEQ ID NO: 3670 - protein, 56 aa, Human herpesvirus 3
PSPVYADLYFEHKNTTPRVHQPNDSSGSEDDFEDIDEVVAAFREARLRHELVEDAV

SEQ ID NO: 3671 - protein, 56 aa, Human herpesvirus 3
QTPCVNFPDKTDVRRPGKRDFKSMDQRELDSFYSGESQMDGEFPSNIYFPGEPTYI

SEQ ID NO: 3672 - protein, 45 aa, Human herpesvirus 3
TSTPHTDTVGQDVNAVEASSKAPLIQGSTADDADMFANQMMVGRC

SEQ ID NO: 3673 - protein, 56 aa, Human herpesvirus 3
IQSGLQPSIKRRLETRLKEVQTYANEARTTQDTIKSRKQAAYNKLGGLLRPVTGFV

SEQ ID NO: 3674 - protein, 56 aa, Human herpesvirus 3
AQPVQPAQPVQPAQPVQPAQPVQPAQPIEPGTQIVVQNFKKPQSVKTTLSQKDIPL

SEQ ID NO: 3675 - protein, 47 aa, Human herpesvirus 3
KDTGNNAITSALRSLRWDNLHPAVEEESVDCANGTTSLLRATEKPLL

SEQ ID NO: 3676 - protein, 56 aa, Human herpesvirus 3
NDDEKTSIIVSRRAADVVTEDVKADDVPISGEPYSEKQPRRRKKSDHITLSNFVQI

SEQ ID NO: 3677 - protein, 56 aa, Human herpesvirus 3
NINTDAIDDEGEAEEGEAEEDAIDDEGEAEEGEAEEDAIDDEGEAEEGEAEEDAAE

SEQ ID NO: 3678 - protein, 56 aa, Human herpesvirus 3
NINTDAIDDEGEAEEGEAEEDAIDDEGEAEEGEAEEDAIDDEGEAEEGEAEEDAID

SEQ ID NO: 3679 - protein, 56 aa, Human herpesvirus 3
LLNSEMDQDSSSDASDDFPGYALHHSTYNGSEQNTSTSRHENRIFKLTEREANEEI

SEQ ID NO: 3680 - protein, 56 aa, Human herpesvirus 3
ASPVGDAAGNDQREDQRSIPRQTTRGNSPGLPSVVHRDRQTQSISGKKPGDEQAGH

SEQ ID NO: 3681 - protein, 56 aa, Human herpesvirus 3
RCTDGPLSRGAKAIMSRAMNHDERGTSDLTRVLLSSNTSCSIKYNKTSETYDSVFR

SEQ ID NO: 3682 - protein, 56 aa, Human herpesvirus 3
ETDPMTWLRPTVGLKRTFNPRIIRPQPPNPSMSLGISGPTILPQKTQSADQSALQQ

SEQ ID NO: 3683 - protein, 56 aa, Human herpesvirus 3
REFDELSRTIKTINTRATQRASAEAELSCFNTLSAAVDQAVKDYETYNNGEVKYPE

SEQ ID NO: 3684 - protein, 56 aa, Human herpesvirus 3; identical to SEQ ID NO: 3654

SEQ ID NO: 3685 - protein, 56 aa, Human herpesvirus 3
PAQPVQPAQPIEPGTQIVVQNFKKPQSVKTTLSQKDIPLYVETESETAVLIPKQLT

SEQ ID NO: 3686 - protein, 56 aa, Human herpesvirus 3
MASSDGDRLCRSNAVRRKTTPSYSGQYRTARRSVVVGPPDDSDDSLGYITTVGADS

SEQ ID NO: 3687 - protein, 56 aa, Human herpesvirus 3
ARLCDLPATPKGSGTSLFQHMLDLRAGKSLEDNPWLHEDVVTTETKSVVKEGIENH

SEQ ID NO: 3688 - protein, 56 aa, Human herpesvirus 3
GEAEEDAAEEDAIDDEGEAEEDYFSVSQVCSRDADEVYFTLDPEISYSTDLRIAKV

SEQ ID NO: 3689 - protein, 56 aa, Human herpesvirus 3
DALNGSNDDEKTSIIVSRRAADVVTEDVKADDVPISGEPYSEKQPRRRKKSDHITL

SEQ ID NO: 3690 - protein, 56 aa, Human herpesvirus 3
NVTAVARGAAHLAFDENHEGAVLPPDITYTYFQSSSSGTTTARGARRNDVNSTSKP

SEQ ID NO: 3691 - protein, 56 aa, Human herpesvirus 3
TELMQNNASPLVVQTRPPAVLIPLVDVPRPRSRRKASAQLKMQMDRLCNVLGVVLQ

SEQ ID NO: 3692 - protein, 56 aa, Human herpesvirus 3
AEEGEAEEDAIDDEGEAEEGEAEEDAAEEDAIDDEGEAEEDAIDDEGEAEEDAIDD

SEQ ID NO: 3693 - protein, 56 aa, Human herpesvirus 3
DVVASADNTRRLVRAQALARTYAACSRNIECLKQHHFTEDNPGLNAVVRSHMENSK

SEQ ID NO: 3694 - protein, 56 aa, Human herpesvirus 3; identical to SEQ ID NO: 3654

SEQ ID NO: 3695 - protein, 56 aa, Human herpesvirus 3; identical to SEQ ID NO: 3673

SEQ ID NO: 3696 - protein, 56 aa, Human herpesvirus 3
PPDDRLRTPRKRKSQPVESRSLLDKIRETPVADARVADDHVVSKAKRRVSEPVTIT

SEQ ID NO: 3697 - protein, 56 aa, Human herpesvirus 3
TCFQDVVVDVDCAENTKEDQLAEISYRFQGKKEADQPWIVVNTSTLFDELELDPPE

SEQ ID NO: 3698 - protein, 56 aa, Human herpesvirus 3
DDICAYGLYNSQFLALMPTVSSAQVTECSEGFSPIYNNMFSKVTTSGELLRPNLDL

SEQ ID NO: 3699 - protein, 56 aa, Human herpesvirus 3
PLFKSPVQVVRSSKCKKMPVRPAQPAQPAQPAQPAQTVQPAQPIEPGTQIVVQNFK

SEQ ID NO: 3700 - protein, 56 aa, Human herpesvirus 3
DQTLRMTAESEVVMSDVVLLEKTLGVVAKPQASFDVSHNHELSIAKGENVGLKTSP

SEQ ID NO: 3701 - protein, 56 aa, Human herpesvirus 3
SEGFSPIYNNMFSKVTTSGELLRPNLDLMDELRDMYSCEEKRLEVINILEKNQWSV

SEQ ID NO: 3702 - protein, 29 aa, Human herpesvirus 2
RRAQMAPKRLRLPHIRDDDAPPSHQPLFY

SEQ ID NO: 3703 - protein, 56 aa, Human herpesvirus 2
TTAMPGTRGTARTPPTDPKTHPHGPTDAPPGSPAPPSPRHRGGPEEFEGAGDGEPP

SEQ ID NO: 3704 - protein, 56 aa, Human herpesvirus 2
MTSRPADQDSVRSSASVPLYPAASPVPAEAYYSESEDEAANDFLVRMGRQQSVLRR

SEQ ID NO: 3705 - protein, 56 aa, Human herpesvirus 2
PKTHPHGPADAPPGSPAPPPPEHRGGPEEFEGAGDGEPPEDDDSATGLAFRTPNPN

SEQ ID NO: 3706 - protein, 56 aa, Human herpesvirus 2
TDPKTHPHGPADAPPGSPAPPPPEHRGGPEEFEGAGDGEPPEDDDSATGLAFRTPN

SEQ ID NO: 3707 - protein, 56 aa, Human herpesvirus 2
TTATPGTRGTARTPPTDPKTHPHGPADAPPGSPAPPPPEHRGGPQEFEGAGDGEPP

SEQ ID NO: 3708 - protein, 42 aa, Human herpesvirus 2
PPGSPAPPSPRHRGGPEEFEGAGDGEPPEDDDSATGPAFRTP

SEQ ID NO: 3709 - protein, 45 aa, Human herpesvirus 2
MERTEHKARKKGTSALLSAKVTDAVMRKRARPRYSPLRDTDEEEL

SEQ ID NO: 3710 - protein, 56 aa, Human herpesvirus 2
PEEFEGAGDGEPPEDDDSATGLAFRTPNPNKPPPARPGPIRPTLPPGILGPLAPNT

SEQ ID NO: 3711 - protein, 49 aa, Human herpesvirus 2
TPPPAASLPQPEAPGAEAGALVNASSAAHVNVDTARAADLFVSQMMGSR

SEQ ID NO: 3712 - protein, 42 aa, Human herpesvirus 2
PPGSPAPPPPEHRGGPQEFEGAGDGEPPEDDHSATGLAFRTP

SEQ ID NO: 3713 - protein, 56 aa, Human herpesvirus 2
ETPYASVSHHAEIDRYGDSDGDPIYDEVAPDHEAELYARVQRPGPVPDAEPIYDTV

SEQ ID NO: 3714 - protein, 47 aa, Human herpesvirus 2
APDHEAELYARVQRPGPVPDAEPIYDTVEGYAPRSAGEPVYSTVRRW

SEQ ID NO: 3715 - protein, 56 aa, Human herpesvirus 2
TAHEFDVVDIESEEEGNFYVPPDVRVVTRAPGPQYRRPSDPPSRHTRRRDPDVARP

SEQ ID NO: 3716 - protein, 56 aa, Human herpesvirus 2
DPAAGKRGDSGLLRVCAALSIPKPSEAVRPSRIPRAPRVPREPRVPREPREPRVPR

SEQ ID NO: 3717 - protein, 56 aa, Human herpesvirus 2
GHPGAGPSPHYPPPPAHPYPGMLFAGPSPLEAQIAALVGAIAADRQAGGLPAAAGD

SEQ ID NO: 3718 - protein, 56 aa, Human herpesvirus 2
APGPSAANVSVAATTATPGTRGTARTPPTDPKTHPHGPADAPPGSPAPPPPEHRGG

SEQ ID NO: 3719 - protein, 56 aa, Human herpesvirus 2
EFEGAGDGEPPEDDDSATGLAFRTPNPNKPPPARPGPIRPTLPPGILGPLAPNTPR

SEQ ID NO: 3720 - protein, 56 aa, Human herpesvirus 2
ATTKARKRKTKKPPKRPEATPPPDANATVAAGHATLRAHLREIKVENADAQFYVCP

SEQ ID NO: 3721 - protein, 56 aa, Human herpesvirus 2
PGDAPDSPYIEAENPLYDWGGSALFSPRRATRAPDPGLSLSPMPARPRTNALANDG

SEQ ID NO: 3722 - protein, 56 aa, Human herpesvirus 2
AESTTGTESEGTGPSDDDDDDASDGWLVDTPPRKSKRPRINLRLTSSPDRRAGVVF

SEQ ID NO: 3723 - protein, 56 aa, Human herpesvirus 2
MNPVSASGAPAPPPPGDGSYLWIPASHYNQLVTGQSAPRHPPLTACGLPAAGTVAY

SEQ ID NO: 3724 - protein, 56 aa, Human herpesvirus 2
LGGHTVRALSPTPPWPGTDDEDDDLADVDYVPPAPRRAPRRGGGGAGATRGTSQPA

SEQ ID NO: 3725 - protein, 50 aa, Human herpesvirus 2
AESTTGTESEGTGPSDDDDDDDASDGWLVDTPPRKSKRPRINLRLTSSPD

SEQ ID NO: 3726 - protein, 48 aa, Human herpesvirus 2
SVPVTHAGDRSPVRPGPVPPADPTPDPRHRTSAPKRQASSTEAPLLLA

SEQ ID NO: 3727 - protein, 56 aa, Human herpesvirus 2
ELSDTTNATQPELVPEDPEDSALLEDPAGTVSSQIPPNWHIPSIQDVAPHHAPAAP

SEQ ID NO: 3728 - protein, 56 aa, Human herpesvirus 2
AQREAAGVYDAVRTWGPDAEAEPDQMENTYLLPDDDAAMPAGVGLGATPAADTTAA

SEQ ID NO: 3729 - protein, 56 aa, Human herpesvirus 2
AAWPAESHAPRAPSEDADSIYESVGEDGGRVYEEIPWVRVYENICPRRRLAGGAAL

SEQ ID NO: 3730 - protein, 56 aa, Human herpesvirus 2
SRASATGPTYIRVADSELYADWSSDSEGERDGSLWQDPPERPDSPSTNGSGFEILS

SEQ ID NO: 3731 - protein, 56 aa, Human herpesvirus 2; identical to SEQ ID NO: 3722

SEQ ID NO: 3732 - protein, 56 aa, Human herpesvirus 2
HGIRGSAKRRRHEVEQPEYDCGRDEPDRDFPYYPGEARPEPRPVDSRRAARQASGP

SEQ ID NO: 3733 - protein, 56 aa, Human herpesvirus 2
RPSRIPRAPRVPREPRVPREPREPRVPRSPREPRVPRIPRDPRPPRPPRVPREPRP

SEQ ID NO: 3734 - protein, 56 aa, Human herpesvirus 2
PLEAQIAALVGAIAADRQAGGLPAAAGDHGIRGSAKRRRHEVEQPEYDCGRDEPDR

SEQ ID NO: 3735 - protein, 56 aa, Human herpesvirus 2
APRASGGVAATVAANGGPASRPPPVPSPATTKARKRKTKKPPKRPEATPPPDANAT

SEQ ID NO: 3736 - protein, 56 aa, Human herpesvirus 2
IVDAAGAEEEDEADDDAPDDVAYPEDYAEGRFLSMVSAAPLPGASGHPPVPGRAAP

SEQ ID NO: 3737 - protein, 56 aa, Human herpesvirus 2
MGLAFSGARPCCCRHNVITTDGGEVVSLTAHEFDVVDIESEEEGNFYVPPDVRVVT

SEQ ID NO: 3738 - protein, 56 aa, Human herpesvirus 2
GEDGAEDFDEAKLAQAREMIRYMALVSAMERTEHKARKKGTSALLSAKVTDAVMRK

SEQ ID NO: 3739 - protein, 56 aa, Human herpesvirus 2
AEAREMIRYMALVSAMERTEHKARKKGTSALLSSKVTNMVLRKRNKARYSPLHNED

SEQ ID NO: 3740 - protein, 56 aa, Human herpesvirus 2
RTTPTPPQPRKATKSKASTAKPAPPPKTGPPKTSSEPVRCNRHDPLARYGSRVQIR

SEQ ID NO: 3741 - protein, 56 aa, Human herpesvirus 2
TPEPQGPQAVPPPPPPPFPWGHECCARRDARGGAEKDVGAAESWSDGPSSDSETED

SEQ ID NO: 3742 - protein, 56 aa, Human herpesvirus 2
RVGEDAAAAEGRTPPARQPRAAQEPPIVISDSPPPSPRRPAGPGPLSFVSSSSAQV

SEQ ID NO: 3743 - protein, 56 aa, Human herpesvirus 2
SSVYTPGASRPTPPRTTTSPSSPRDPTPAPGDTGTPAPASGERAPPNSTRSASESR

SEQ ID NO: 3744 - protein, 56 aa, Human herpesvirus 2
AAMARLGAELRSHPNTPPKPRRRSSSSTTMPSLTSIAEESEPGPVVLLSVSPRPRS

SEQ ID NO: 3745 - protein, 56 aa, Human herpesvirus 2
PDRRPAARPGFGWHGGPEENEDEADDAAADADADEAAPASGEAVDEPAADGVVSPR

SEQ ID NO: 3746 - protein, 56 aa, Human herpesvirus 2
ERDGSLWQDPPERPDSPSTNGSGFEILSPTAPSVYPHSEGRKSRRPLTTFGSGSPG

SEQ ID NO: 3747 - protein, 56 aa, Human herpesvirus 2
PGRTITVGPRGNASNAAPSASPRNASAPRTTPTPPQPRKATKSKASTAKPAPPPKT

SEQ ID NO: 3748 - protein, 56 aa, Human herpesvirus 2
LGDELRLDGEEVDMTPADALDDFDLEMLGDVESPSPGMTHDPVSYGALDVDDFEFE

SEQ ID NO: 3749 - protein, 56 aa, Human herpesvirus 2
TALTEACAAERVVRPHQLSPAAQTALLRRFPALEGPLRHPRPVLQPFDIAAEVAFV

SEQ ID NO: 3750 - protein, 56 aa, Human herpesvirus 2
RSQDDYGAVVVAAAHHSSGAPGPGVAASGPPAPPGRGPARPWHQAVQLFRAPRPGP

SEQ ID NO: 3751 - protein, 56 aa, Human herpesvirus 2
PADPESPRDDFRRGAGPMRARPRGEVRFLHYDEAGYALYRDSSSDDDESRDTARPR

SEQ ID NO: 3752 - protein, 56 aa, Human herpesvirus 2
RTFIRMARPTEDGVLPPHWAPGALDDGPYAPFPPRPRFRRALRTDPEGVDPDVRAP

SEQ ID NO: 3753 - protein, 56 aa, Human herpesvirus 2
LADQEEQLEEAAANASLWGDGDLADGWMSPGDSDLLVMWQLTSAPKVHTDAPSRPG

SEQ ID NO: 3754 - protein, 56 aa, Human herpesvirus 2
KAVYLPPPHIAPPGPPLSGAVPPPSYPPVAVTPGPAPPLHQPSPAHAHPPPPPPGP

SEQ ID NO: 3755 - protein, 56 aa, Human herpesvirus 2
LGGHTVRALSPTPPWPGTDDEDDDLADADYVPPAPRRAPRRGGGGAGATRGTSQPA

SEQ ID NO: 3756 - protein, 56 aa, Human herpesvirus 2
TEDASSDSPTSAPEKTPLPVSATAMAPSVDPSAEPTAPATTTPPDEMATQAATVAV

SEQ ID NO: 3757 - protein, 56 aa, Human herpesvirus 2
DGMQPRGADTLEGHSLPTDGPPHRGGDHDPAAGKRGDSGLLRVCAALSIPKPSEAV

SEQ ID NO: 3758 - protein, 56 aa, Human herpesvirus 2
ALGGTSGPSATTSVGTQTSGEFLHGNPRTPEPQGPQAVPPPPPPPFPWGHECCARR

SEQ ID NO: 3759 - protein, 56 aa, Human herpesvirus 2
RISDSSFVQCGSNCSMIIDGDVARGHLRDLEGATSTGAFVAISNVAAGGDGRTAVV

SEQ ID NO: 3760 - protein, 19 aa, Human herpesvirus 2
MKTKPLPTAPMAWAESAVE

SEQ ID NO: 3761 - protein, 56 aa, Human herpesvirus 2
PADTQETTTRRALYKEIRDALGSRKQAVSHAPVRAGCVNFDYSRTRRCVGRRDLRP

SEQ ID NO: 3762 - protein, 56 aa, Human herpesvirus 2
ADTCMATILQMYMSVGAADKSADVLVSQAIRSMAESDVVMEDVAIAERALGLSTSA

SEQ ID NO: 3763 - protein, 56 aa, Human herpesvirus 2
TATIRSTLPVSYEQTEYICRLAGYPDGIPVLEHHGSHQPPPRDPTERQVIRAVEGA

SEQ ID NO: 3764 - protein, 41 aa, Human herpesvirus 2
PTAPSVYPHSEGRKSRRPLTTFGSGSPGRRHSQASYPSVLW

SEQ ID NO: 3765 - protein, 56 aa, Human herpesvirus 2
SSGPGGGGLPQSSGRAARPRAAVAPRVRSPPRAAAAPVVSASADAAGPAPPAVPVD

SEQ ID NO: 3766 - protein, 56 aa, Human herpesvirus 2
DDAEWANSPPSEGGGKAPEAPHAAPAAACPPPPPRKERGPQRPLPPHLALRLRTTT

SEQ ID NO: 3767 - protein, 56 aa, Human herpesvirus 2
TPRPAARRGADDPPPATTGVWSRLGTRRSASPREPHGGKVARIQPPSTKAPHPRGG

SEQ ID NO: 3768 - protein, 56 aa, Human herpesvirus 2
DTPPRKSKRPRINLRLTSSPDRRAGVVFPEVWRSDRPIRAAQPQAPASLPGIAHAH

SEQ ID NO: 3769 - protein, 56 aa, Human herpesvirus 2
PNTLLLKELERTFGGKRLLDAMDGLEAKQWSVAQALPCLDPAHPLRRFKTAFDYDQ

SEQ ID NO: 3770 - protein, 56 aa, Human herpesvirus 2
SPGDSDLLVMWQLTSAPKVHTDAPSRPGSRPTYTPSAAGRPDAQAAPPPETAPSPE

SEQ ID NO: 3771 - protein, 56 aa, Human herpesvirus 2
SVPAPQVAVRARQVASSSSSSSFPAPADMNPVSASGAPAPPPPGDGSYLWIPASHY

SEQ ID NO: 3772 - protein, 56 aa, Human herpesvirus 2
DGGAEAIDAAIPKGPPARPEDAGTPEASTPRPAARRGADDPPPATTGVWSRLGTRR

SEQ ID NO: 3773 - protein, 56 aa, Human herpesvirus 2
DDDSDSDSRSDDSVQPDVVVRRRWSDGPAPVAFPKPRRPGDSPGNPGLGAGTGPGS

SEQ ID NO: 3774 - protein, 56 aa, Human herpesvirus 2
RTFIRMARPTEDVGVLPPHWAPGALDDGPYAPFPPRPRFRRALRTDPEGVDPDVRA

SEQ ID NO: 3775 - protein, 56 aa, Human herpesvirus 2
APHAWGMLNDMQWLASSDSEEETEVGISDDDLHRDSTSEAGSTDTEMFEAGLMDAA

SEQ ID NO: 3776 - protein, 56 aa, Human herpesvirus 2; identical to SEQ ID NO: 3775

SEQ ID NO: 3777 - protein, 56 aa, Human herpesvirus 2
EAEAAVRSGTAVDFIWTGNPRTAPRSLSLGGHTVRALSPTPPWPGTDDEDDDLADA

SEQ ID NO: 3778 - protein, 56 aa, Human herpesvirus 2
AIRSMAESDVVMEDVAIAERALGLSTSALAGGTRTAGLGATEAPPGPTRAQAPEVA

SEQ ID NO: 3779 - protein, 56 aa, Human herpesvirus 2
RLQRNPMKALYPLTTKELKSDGAPLAGGGEDGAEDFDEAKLAQAREMIRYMALVSA

SEQ ID NO: 3780 - protein, 56 aa, Human herpesvirus 2
DTPPRKSKRPRINLRLTSSPDRRAGVVFPEVWRSDRPIRAAQPQAPAQSSGDRAHA

SEQ ID NO: 3781 - protein, 56 aa, Human herpesvirus 2
RSHAPPARTPKMTRGAPKASATPATDPARGRRPAQADSAVLLDAPAPTASGRTKTP

SEQ ID NO: 3782 - protein, 56 aa, Human herpesvirus 2
MASGVSPAHPQTPVGAGSRDLSLKGTPSDGMQPRGADTLEGHSLPTDGPPHRGGDH

SEQ ID NO: 3783 - protein, 56 aa, Human herpesvirus 2
MTSRRSVKSCPREAPRGTHEELYYGPVSPADPESPRDDFRRGAGPMRARPRGEVRF

SEQ ID NO: 3784 - protein, 56 aa, Human herpesvirus 2
LADPSLKMADPNRFRGKNLPVLDRLTDPPGVKRVYHIQPSLEDPFQPPSIPITVYY

SEQ ID NO: 3785 - protein, 56 aa, Human herpesvirus 2; identical to SEQ ID NO: 3742

SEQ ID NO: 3786 - protein, 56 aa, Human herpesvirus 2
GPSAANVSVAATTATPGTRGTARTPPTDPKTHPHGPADAPPGSPAPPPPEHRGGPE

SEQ ID NO: 3787 - protein, 56 aa, Human herpesvirus 2
ASQDSRAGPTDSQDSSSEPDAGDRGAPEEEGLEGQARVPPAFPEPPGTKRRHPGAE

SEQ ID NO: 3788 - protein, 50 aa, Human herpesvirus 2
STPEPTTPGPQDTQARAPSTRPAGRETVPWPNTPVEDDEMTPQETPPVHP

SEQ ID NO: 3789 - protein, 56 aa, Human herpesvirus 2
DGVFRASAFRPSAGPGAPGDLEAQDAGGSTPEPTTPGPQDTQARAPSTRPAGRETV

SEQ ID NO: 3790 - protein, 56 aa, Human herpesvirus 2
FRRALRTDPEGVDPDVRAPRTGRRLMALTEDASSDSPTSAPEKTPLPVSATAMAPS

SEQ ID NO: 3791 - protein, 56 aa, Human herpesvirus 2
AHRAPRSRMTQAQTDTQAQSLGRAGATDARGSGGPGAEGGPGVPRGTNTPGAAPHA

SEQ ID NO: 3792 - protein, 56 aa, Human herpesvirus 2
DFPYYPGEARPEPRPVDSRRAARQASGPHETITALVGAVTSLQQELAHMRARTHAP

SEQ ID NO: 3793 - protein, 56 aa, Human herpesvirus 2
ADADADEAAPASGEAVDEPAADGVVSPRQLALLASMVDEAVRTIPSPPPERDGAQE

SEQ ID NO: 3794 - protein, 56 aa, Human herpesvirus 2
VSATAMAPSVDPSAEPTAPATTTPPDEMATQAATVAVTPEETAVASPPATASVESS

SEQ ID NO: 3795 - protein, 56 aa, Human herpesvirus 2
ISDSPPPSPRRPAGPGPLSFVSSSSAQVSSGPGGGGLPQSSGRAARPRAAVAPRVR

SEQ ID NO: 3796 - protein, 56 aa, Human herpesvirus 2
KPPPARPGPIRPTLPPGILGPLAPNTPRPPAQAPAKDMPSGPTPQHIPLFWFLTAS

SEQ ID NO: 3797 - protein, 49 aa, Human herpesvirus 2
VDPSAEPTAPATTTPPDEMATQAATVAVTPEETAVASPPATASVESSPL

SEQ ID NO: 3798 - protein, 56 aa, Human herpesvirus 2
HGWPAFAPTTPGDDAGGGTAAPQTCGIVKRLLKLAATEQQGTTPPAIAALMQDASV

SEQ ID NO: 3799 - protein, 56 aa, Human herpesvirus 2
MATDIDMLIDLGLDLSDSELEEDALERDEEGRRDDPESDSSGECSSSDEDMEDPCG

SEQ ID NO: 3800 - protein, 50 aa, Human herpesvirus 2
RATRAPDPGLSLSPMPARPRTNALANDGPTNVAALSALLTKLKRGRHQSH

SEQ ID NO: 3801 - protein, 56 aa, Human herpesvirus 2
DLEGATSTGAFVAISNVAAGGDGRTAVVALGGTSGPSATTSVGTQTSGEFLHGNPR

SEQ ID NO: 3802 - protein, 56 aa, Human herpesvirus 2
HETITALVGAVTSLQQELAHMRARTHAPYGPYPPVGPYHHPHADTETPAQPPRYPA

SEQ ID NO: 3803 - protein, 56 aa, Human herpesvirus 2
SHAPVRAGCVNFDYSRTRRCVGRRDLRPANTTSTWEPPVSSDDEASSQSKPLATQP

SEQ ID NO: 3804 - protein, 36 aa, Human herpesvirus 2
TPAPTTPPPTSTHATPRPTTPGPQTTPPGPATPGPV

SEQ ID NO: 3805 - protein, 56 aa, Human herpesvirus 2
MEPRPGTSSRADPGPERPPRQTPGTQPAAPHAWGMLNDMQWLASSDSEEETEVGIS

SEQ ID NO: 3806 - protein, 56 aa, Human herpesvirus 2
ENEEILALVQRAVQDVTRRHPVRARPKHAASGVASGLRQGALVHQAVSGGALGASD

SEQ ID NO: 3807 - protein, 56 aa, Human herpesvirus 2
MAGAPPRLPPRNPAPPEQRPAAAARPLAAQREAAGVYDAVRTWGPDAEAEPDQMEN

SEQ ID NO: 3808 - protein, 56 aa, Human herpesvirus 2
MSRDASHAALRRRLAETHLRAEVYRDQTLQLHREGVSTQDPRFVGAFMAAKAAHLE

SEQ ID NO: 3809 - protein, 56 aa, Human herpesvirus 2
ASASSSDDDDDDDAARAPASAADHAAGGTLGADDEEAGVPARAPGAAPRPSPPRAE

SEQ ID NO: 3810 - protein, 56 aa, Human herpesvirus 2; identical to SEQ ID NO: 3808

SEQ ID NO: 3811 - protein, 56 aa, Human herpesvirus 2
PVSATAMAPSVDPSAEPTAPATTTPPDEMATQAATVAVTPEETAVASPPATASVES

SEQ ID NO: 3812 - protein, 56 aa, Human herpesvirus 2
MKTKPLPTAPMAWAESAVETTTGPRELAGHAPLRRVLRPPIARRDGPVLLGDRAPR

SEQ ID NO: 3813 - protein, 56 aa, Human herpesvirus 2
CPPPPPRKERGPQRPLPPHLALRLRTTTEYLARLSLRRRRPPASPPADAPRGKVCF

SEQ ID NO: 3814 - protein, 56 aa, Human herpesvirus 2; identical to SEQ ID NO: 3791

SEQ ID NO: 3815 - protein, 42 aa, Human herpesvirus 2
GDVESPSPGMTHDPVSYGALDVDDFEFEQMFTDAMGIDDFGG

SEQ ID NO: 3816 - protein, 56 aa, Human herpesvirus 2; identical to SEQ ID NO: 3805

SEQ ID NO: 3817 - protein, 56 aa, Human herpesvirus 2
SDSSDEDTGSGSETLSRSSSIWAAGATDDDDSDSDSRSDDSVQPDVVVRRRWSDGP

SEQ ID NO: 3818 - protein, 56 aa, Human herpesvirus 2
ELKTSDPGGVGGEGEEGAEGGGFDEAKLAEAREMIRYMALVSAMERTEHKARKKGT

SEQ ID NO: 3819 - protein, 56 aa, Human herpesvirus 2
EEGLEGQARVPPAFPEPPGTKRRHPGAEVVPADDATKRPKTGVPAAPTRAESPPLS

SEQ ID NO: 3820 - protein, 22 aa, Human herpesvirus 2
IPVLEHHGSHQPPPRDPTERQV

SEQ ID NO: 3821 - protein, 56 aa, Human herpesvirus 2
EDVGVLPPHWAPGALDDGPYAPFPPRPRFRRALRTDPEGVDPDVRAPRTGRRLMAL

SEQ ID NO: 3822 - protein, 56 aa, Human herpesvirus 2
KRLLKLAATEQQGTTPPAIAALMQDASVQTPLPVYRITMSPTGQAFAAAARDDWAR

SEQ ID NO: 3823 - protein, 30 aa, Human herpesvirus 2
TAAGLATPPRREPVDMDAELEDDDDGLFGE

SEQ ID NO: 3824 - protein, 56 aa, Human herpesvirus 2
EAEAAVRAGTAVDFIWTGNPRTAPRSLSLGGHTVRALSPTPPWPGTDDEDDDLADV

SEQ ID NO: 3825 - protein, 56 aa, Human herpesvirus 2
MTTQAATVAVTPEETAVASPPATASVESSPLPAAAATPGAGHTNTSSAPAAKTPPT

SEQ ID NO: 3826 - protein, 56 aa, Human herpesvirus 2
PWFLHGLGLARTYWRDTNTGRLWLPNTPDASDPQRGRLAPPGELNLTTASVPMLRW

SEQ ID NO: 3827 - protein, 56 aa, Human herpesvirus 2
GRVYEEIPWVRVYENICPRRRLAGGAALPGDAPDSPYIEAENPLYDWGGSALFSPR

SEQ ID NO: 3828 - protein, 56 aa, Human herpesvirus 2
TYLLPDDDAAMPAGVGLGATPAADTTAAAAWPAESHAPRAPSEDADSIYESVGEDG

SEQ ID NO: 3829 - protein, 56 aa, Human herpesvirus 2
LAGGTRTAGLGATEAPPGPTRAQAPEVASVPVTHAGDRSPVRPGPVPPADPTPDPR

SEQ ID NO: 3830 - protein, 15 aa, Human herpesvirus 2
MAFRPSGPAYQPLAP

SEQ ID NO: 3831 - protein, 56 aa, Human herpesvirus 2
SPPRAAAAPVVSASADAAGPAPPAVPVDAHRAPRSRMTQAQTDTQAQSLGRAGATD

SEQ ID NO: 3832 - protein, 56 aa, Human herpesvirus 2
LESLDDTRRLVKARALARTYHACMVNLERLARHHPGLEGSTIDGAVAAHRDKMRRL

SEQ ID NO: 3833 - protein, 40 aa, Human herpesvirus 2
RAPGPQYRRPSDPPSRHTRRRDPDVARPPATLTPPLSDSE

SEQ ID NO: 3834 - protein, 56 aa, Human herpesvirus 2
APRSPLAPQGVGAKRAAPRRAPDSDSGDRGHGPLAPASAGAAPPSASPSSQAAVAA

SEQ ID NO: 3835 - protein, 56 aa, Human herpesvirus 2
SEDEAGDLRGGRRRSPRELGGRYFLDLSAESTTGTESEGTGPSDDDDDDDASDGWL

SEQ ID NO: 3836 - protein, 56 aa, Human herpesvirus 2
GTVSSQIPPNWHIPSIQDVAPHHAPAAPSNPGLIIGALAGSTLAVLVIGGIAFWVR

SEQ ID NO: 3837 - protein, 56 aa, Human herpesvirus 2
ADRDRFRRRVAAAEAVIGPCLEPEARARARARARAHEDGGPAEEEEAAAAARGSSA

SEQ ID NO: 3838 - protein, 56 aa, Human herpesvirus 2
SPLPAAAAATPGAGHTNTSSASAAKTPPTTPAPTTPPPTSTHATPRPTTPGPQTTP

SEQ ID NO: 3839 - protein, 56 aa, Human herpesvirus 2
ANSRSLESMPTLTAAPVGLETRISWTEILAQQIAGEDDYEEDPPLQPPDVAGGPRD

SEQ ID NO: 3840 - protein, 56 aa, Human herpesvirus 2
SEDEVGDLRGGRRRPPRELGGRYFLDLSAESTTGTESEGTGPSDDDDDDASDGWLV

SEQ ID NO: 3841 - protein, 56 aa, Human herpesvirus 2; identical to SEQ ID NO: 3831

SEQ ID NO: 3842 - protein, 56 aa, Human herpesvirus 2
RPPSPGEAARLCQLQEILAQMHSDEDYPIVDAAGAEEEDEADDDAPDDVAYPEDYA

SEQ ID NO: 3843 - protein, 56 aa, Human herpesvirus 2
ATTGEPVPPRMWAWIHGLEELASDDAGGPTPNPAPALLPPPATDQSVPTSQYAPRP

SEQ ID NO: 3844 - protein, 36 aa, Human herpesvirus 2
SALLSSKVTNMVLRKRNKARYSPLHNEDEAGDEDEL

SEQ ID NO: 3845 - protein, 35 aa, Human herpesvirus 2
RPWKSSAPTRVPWSKSMLPTGVIQRLFHSDAGGVG

SEQ ID NO: 3846 - protein, 48 aa, Human herpesvirus 2
QRANELVNPDAAQDVDATAAARGRPAGRAAATARAPARSASRPRRPLE

SEQ ID NO: 3847 - protein, 56 aa, Human herpesvirus 2
KVKLSSYKLNAVAEAVLKDKKKDLSYRDIPAYYASGPAQRGVIGEYCVQDSLLVGQ

SEQ ID NO: 3848 - protein, 56 aa, Human herpesvirus 2
NAKGVCRSTAKYVRNNMETTAFHRDDHETDMELKPAKVATRTSRGWHTTDLKYNPS

SEQ ID NO: 3849 - protein, 56 aa, Human herpesvirus 2
EEGRRDDPESDSSGECSSSDEDMEDPCGDGGAEAIDAAIPKGPPARPEDAGTPEAS

SEQ ID NO: 3850 - protein, 56 aa, Human herpesvirus 2
PLLSNTLAELYVREYMREQDRKPRNATPAPLREAPSANASVERIKTTSSIEFARLQ

SEQ ID NO: 3851 - protein, 56 aa, Human herpesvirus 2
DLFFKRLIRHLDGEKNVTWSLFDRDTSMSLADFHGEEFEKLYEHLEAMGFGETIPI

SEQ ID NO: 3852 - protein, 56 aa, Human herpesvirus 2
SLADFHGEEFEKLYEHLEAMGFGETIPIQDLAYAIVRSAATTGSPFIMFKDAVNRH

SEQ ID NO: 3853 - protein, 56 aa, Human herpesvirus 2
SEDEAGDLRGGRRRSPRELGGRYFLDLSAESTTGTESEGTGPSDDDDDDASDGWLV

SEQ ID NO: 3854 - protein, 56 aa, Human herpesvirus 2
SPLPAAAATPGAGHTNTSSAPAAKTPPTTPAPTTPPPTSTHATPRPTTPGPQTTPP

SEQ ID NO: 3855 - protein, 56 aa, Human herpesvirus 2
TLGADDEEAGVPARAPGAAPRPSPPRAEPAPARTPAATAGRLERRRARAAVAGRDA

SEQ ID NO: 3856 - protein, 56 aa, Human herpesvirus 2
GSFIRMARPTEDVGVLPPHWAPGALDDGPYAPFPPRPRFRRALRTDPEGVDPDVRA

SEQ ID NO: 3857 - protein, 56 aa, Human herpesvirus 2
IRARSVPQPPLPQPPLPQPPLPQPPLPQPPLPQPPLPQPPLPQPPLPQPPLPQPPL

SEQ ID NO: 3858 - protein, 56 aa, Human herpesvirus 2
MASHAGQQHAPAFGQAARASGPTDGRAASRPSHRQGASEARGDPELPTLLRVYIDG

SEQ ID NO: 3859 - protein, 56 aa, Human herpesvirus 2
NGLFRDALAAGTVAEQLLMFDLLPPKDVPVGSDARADSAALLRFVDSQRLTPGGSV

SEQ ID NO: 3860 - protein, 56 aa, Human herpesvirus 2
PPQIRWASAAGRAGTVLAAAGGGVEVVGTAAGLATPPRREPVDMDAELEDDDDGLF

SEQ ID NO: 3861 - protein, 56 aa, Human herpesvirus 2
MADIPPDPPALNTTPANHAPPSPPPGSRKRRRPVLPSSSESEGKPDTESESSSTES

SEQ ID NO: 3862 - protein, 56 aa, Human herpesvirus 2
PRPAALTRRPAEGPDPQGGWRRQPPGPSHTPAPSAAALEAYCAPRAVAELTDHPLF

SEQ ID NO: 3863 - protein, 56 aa, Human herpesvirus 2
VASASGAGERRETSLGPRAAAPRGPRKCARKTRHAEGGPEPGARDPAPGLTRYLPI

SEQ ID NO: 3864 - protein, 56 aa, Human herpesvirus 2
MDTKPKTTTTVKVPPGPMGYVYGRACPAEGLELLSLLSARSGDADVAVAPLIVGLT

SEQ ID NO: 3865 - protein, 56 aa, Human herpesvirus 2
IGPAATARETRPSVPPQQNTGRVPVAPRDDPRPSPPTPSPPADAALPPPAFSGSAA

SEQ ID NO: 3866 - protein, 56 aa, Human herpesvirus 2
DRGAVVPPPLLAQFQHTVREIDPAIMIPPLEATKMVRSREEVRVSTALSRVSPRSA

SEQ ID NO: 3867 - protein, 56 aa, Human herpesvirus 2
ASVEDVLRECHWTAPSRSQARRAARRERANSRSLESMPTLTAAPVGLETRISWTEI

SEQ ID NO: 3868 - protein, 56 aa, Human herpesvirus 2
APRQPLDARDRRTDVVITGTRAPRPMAGTGAGGAGAKRATVSEFVQVKHIDRVVSP

SEQ ID NO: 3869 - protein, 56 aa, Human herpesvirus 2
PPHADGRAPVPERKAPSADTIDPAVRAVLRSISERAAVERISESFGRSALVMQDPF

SEQ ID NO: 3870 - protein, 56 aa, Human herpesvirus 2
QRTVALYSLKIAGWHGPKPPYTSTLLPPELSDTTNATQPELVPEDPEDSALLEDPA

SEQ ID NO: 3871 - protein, 56 aa, Human herpesvirus 2
NAHNQGGRHPASARTDGPGATHGEARRGGEQLDVSGGPRPRGTRQAPPPLMALSLT

SEQ ID NO: 3872 - protein, 56 aa, Human herpesvirus 2
APRSPLAPQGVGAKRAAPRRAPDSDSGGRGHGPLAPASAGAAPPSASPSSQAAVAA

SEQ ID NO: 3873 - protein, 56 aa, Human herpesvirus 2
AAASSSSSSSASSSSSSASSSAGGAGGSVASASGAGERRETSLGPRAAAPRGPRKC

SEQ ID NO: 3874 - protein, 56 aa, Human herpesvirus 2
PPLVREARAVVTPRPPIRPSSGKASSDDADVGDELIAIADARGDPPETLPPGAGGA

SEQ ID NO: 3875 - protein, 56 aa, Human herpesvirus 2
DARGKPAAAAAPLPSAAASPADERAVPAGYGAAGVLAALGRLSAAPASAPAGADDD

SEQ ID NO: 3876 - protein, 56 aa, Human herpesvirus 2
DLPEPPHVDAADRGPEPCAGRPATYYTHMAGAPPRLPPRNPAPPEQRPAAAARPLA

SEQ ID NO: 3877 - protein, 56 aa, Human herpesvirus 2
AQRTAAAAALENAALQAAELPVDIERRIRPIEQQVHHIADALEALETAAAAAEEAD

SEQ ID NO: 3878 - protein, 56 aa, Human herpesvirus 2
NGTFVYNGSDYGSCDPAQLPFSAPRLGPSSVYTPGASRPTPPRTTTSPSSPRDPTP

SEQ ID NO: 3879 - protein, 56 aa, Human herpesvirus 2
ATQAATVAVTPEETAVASPPATASVESSPPPAAAATPGAGHTNTSSASAAKTPPTT

SEQ ID NO: 3880 - protein, 56 aa, Human herpesvirus 2
SQPTVGTDPGYPVPLELTPENAEAVARFLGDAVDREPALMLEYFCRCAREESKRVP

SEQ ID NO: 3881 - protein, 56 aa, Human herpesvirus 2
ATDPRASADSDSAAHAAAPQADVAPVLDSQPTVGTDPGYPVPLELTPENAEAVARF

SEQ ID NO: 3882 - protein, 56 aa, Human herpesvirus 2
INQTLLFLGPPTAPPGGAWTPHARVCYANIIEGRAVSLPAIPGAMSRRVMNVHEAV

SEQ ID NO: 3883 - protein, 56 aa, Human herpesvirus 2
HWTAPSRSQARRAARRERANSRSLESMPTLTAAPVGLETRISWTEILAQQIAGEDD

SEQ ID NO: 3884 - protein, 56 aa, Human herpesvirus 2
PPGGDHVFCRKVSGVMVLSSDPPGPAAYRISDSSFVQCGSNCSMIIDGDVARGHLR

SEQ ID NO: 3885 - protein, 56 aa, Human herpesvirus 2
SVVGLSDEARQVASVVLVVEPAPVPTPTPDDYDEEDDAGVTNARRSAFPPQPPPRR

SEQ ID NO: 3886 - protein, 56 aa, Human herpesvirus 2; identical to SEQ ID NO: 3858

SEQ ID NO: 3887 - protein, 56 aa, Human herpesvirus 2
PESLIVDGLASDPHYDYIRHYASAAKQALGEVELSGGQLSRAILAQYWKYLQTVVP

SEQ ID NO: 3888 - protein, 56 aa, Human herpesvirus 2
AKPTTFELGPNGKFSVFNARTCVTFAAREEGASSSTSAQVQILTSALKKAGQAAAN

SEQ ID NO: 3889 - protein, 56 aa, Human herpesvirus 2
NQLVTGQSAPRHPPLTACGLPAAGTVAYGHPGAGPSPHYPPPPAHPYPGMLFAGPS

SEQ ID NO: 3890 - protein, 56 aa, Human herpesvirus 2
RETSLGPRAAAPRGPRKCARKTRHAEGGPEPGARDPAPGLTRYLPIAGVSSVVALA

SEQ ID NO: 3891 - protein, 56 aa, Human herpesvirus 2
LIRAKLDSYSSVATSEGESVMREHAYSRGRTRNNYGSTIEGLLDLPDDDDAPAEAG

SEQ ID NO: 3892 - protein, 56 aa, Human herpesvirus 2
APAASSLLRRWLLVPQADDSDDADYAGNDDAEWANSPPSEGGGKAPEAPHAAPAAA

SEQ ID NO: 3893 - protein, 56 aa, Human herpesvirus 2
PVSATAMAPSVDPSAEPTAPATTTPPDEMTTQAATVAVTPEETAVASPPATASVES

SEQ ID NO: 3894 - protein, 56 aa, Human herpesvirus 2
DDGDGDWFPDAGGPGDEEWEEDTDPMDTTHGPLPDDEAAYLDLLHEQIPAATPSEP

SEQ ID NO: 3895 - protein, 56 aa, Human herpesvirus 2
SSASSSSASSSAGGAGGSVASASGAGERRETSLGPRAAAPRGPRKCARKTRHAEGG

SEQ ID NO: 3896 - protein, 56 aa, Human herpesvirus 2
LVAPRMSFLSAGQRPRRLSTTAPITDVSLGDELRLDGEEVDMTPADALDDFDLEML

SEQ ID NO: 3897 - protein, 51 aa, Human herpesvirus 2
SRPTYTPSAAGRPDAQAAPPPETAPSPEPAPGPAADPASGSGFARDCPDGE

SEQ ID NO: 3898 - protein, 56 aa, Human herpesvirus 2
PNKPPPARPGPIRPTLPPGILGPLAPNTPRPPAQAPAKDMPSGPTPQHIPLFWFLT

SEQ ID NO: 3899 - protein, 56 aa, Human herpesvirus 2
DAAEEAEDLRVLEVGAVPVGRHRARYSTGLPKRRRPTWTPPSSVEDLTSGERPAPK

SEQ ID NO: 3900 - protein, 56 aa, Human herpesvirus 2
PMTYWQVLGASETLTNIYNTQHRLDRGEISAGEAAVVMTSAQITMSTPYAATDAVL

SEQ ID NO: 3901 - protein, 56 aa, Human herpesvirus 2
PATPGPVGASAAPTADSPLTALPPATAPGPSAANVSVAATTATPGTRGTARTPPTD

SEQ ID NO: 3902 - protein, 56 aa, Human adenovirus B
PNNGIESLVDKMSRWKTYAQDHRDEPRILGATSRPSRRRQRHDRQMGLVWDDEDSA

SEQ ID NO: 3903 - protein, 56 aa, Human adenovirus B
TMQLMVPKRQRLEDVLEKMKVDPDIQPEVKVRPIKQVAPGLGVQTVDIKIPTESME

SEQ ID NO: 3904 - protein, 56 aa, Human adenovirus B
PTMQLMVPKRQKLEDVLEKVKVDPDIQPEVKVRPIKQVAPGLGVQTVDIKIPTESM

SEQ ID NO: 3905 - protein, 56 aa, Human adenovirus B
VKVRPIKQVAPGLGVQTVDIKIPTESMEVQTEPAKPTTTSIEVQTDPWMTAPVTTP

SEQ ID NO: 3906 - protein, 56 aa, Human adenovirus B
EVKVRPIKQVAPGLGVQTVDIKIPTESMEVQTEPAKPTATSTEVQTDPWMPMPITT

SEQ ID NO: 3907 - protein, 56 aa, Human adenovirus B
IIEMDVASENGQRAMKENPDRAKITQNRWGRNVVQLANNDARCCVNDANCATNQFS

SEQ ID NO: 3908 - protein, 56 aa, Human adenovirus B
TPGEMEVEEELPPLEKRGDKRPRPELEQTLVTRADEPPSYEEAVKLGMPTTRPVAH

SEQ ID NO: 3909 - protein, 56 aa, Human adenovirus B
TLVTRVDEPPSYEEATKLGMPTTRPIAPMATGVMKPSQLHRPVTLDLPPPPAATAV

SEQ ID NO: 3910 - protein, 56 aa, Human adenovirus B
LGATSRPSRRRQRHDRQMGLVWDDEDSADDSSVLDLGGKGVGNPFAHLRPRFGRML

SEQ ID NO: 3911 - protein, 56 aa, Human adenovirus B
MSKEIPTPYMWSYQPNRLAAGASRTTTPLVLLSAGPSMISRVNDIELIETSSPRTV

SEQ ID NO: 3912 - protein, 56 aa, Human adenovirus B
GRINRPRLMGEDEYLNDSLLRPEREKNFPNNGIESLVDKMSRWKTYAQDHRDEPRI

SEQ ID NO: 3913 - protein, 56 aa, Human adenovirus B
AEEVEEATAAKQLSSAAETSKSPDSSTATISAPGRGAQRRPNSRWDETGRFPNPTT

SEQ ID NO: 3914 - protein, 56 aa, Human adenovirus B
SLKPVTLQQVLPVPPRRGNKREGEDLYPTMQLMVPKRQRLEDVLEKMKVDPDIQPE

SEQ ID NO: 3915 - protein, 56 aa, Human adenovirus B
QIIEMDVASENGQRALKENPERTKITQNRWGRSVVQIANNDARCCVNDAGCAANQF

SEQ ID NO: 3916 - protein, 56 aa, Human adenovirus B
TLVTRADEPPSYEEAVKLGMPTTRPVAHMATGVMKPSQSHRPATLDLPPPPASAAP

SEQ ID NO: 3917 - protein, 56 aa, Human adenovirus B; identical to SEQ ID NO: 3913

SEQ ID NO: 3918 - protein, 56 aa, Human adenovirus B
APGEMEVEEELPPLEKRGDKRPRPDMEETLVTRGDEPPPYEEAIKLGMPTTRPIAP

SEQ ID NO: 3919 - protein, 56 aa, Human adenovirus B
EEVTADKQLSSAAETSNSATISAPSRGTRRRPSSRWDETGRFPNPTSASKTAPTIA

SEQ ID NO: 3920 - protein, 56 aa, Human adenovirus B
TISAPGRGAQRRPNSRWDETGRFPNPTTASKTGKKERQGYKSWRGHKNAIISCLHE

SEQ ID NO: 3921 - protein, 56 aa, Human adenovirus B
TLVTRGDEPPPYEEAIKLGMPTTRPIAPMATGVMKPSQSHRPATLDLPPAPAAAAP

SEQ ID NO: 3922 - protein, 43 aa, Human adenovirus B
HDRQMGLVWDDEDSADDSSVLDLGGRGGGNPFAHLRPRFGRML

SEQ ID NO: 3923 - protein, 56 aa, Human adenovirus B
MSHRRGSKKLKVQLSPPEDMKEHWDSQAEEEMEDWDSQAEEVDSLEEDSLEEEDEE

SEQ ID NO: 3924 - protein, 56 aa, Human adenovirus B
MGDDPEPPVQPFDPPTLHDLYDLEVDGPEDPNEEAVNGFFTDSMLLAADEGLDINP

SEQ ID NO: 3925 - protein, 56 aa, Human adenovirus B
YSELSPQYDTTKLYLVDNKSADIASLNYQNDHSNFLTTVVQNNDFTPTEASTQTIN

SEQ ID NO: 3926 - protein, 56 aa, Human adenovirus B
MGDDPEPPVQPFDPPTLHDLYDLEVDGPQDPNEEAVNGFFTDSMLLAADEGLDINP

SEQ ID NO: 3927 - protein, 56 aa, Human adenovirus B
EEEMEDWDSQAEEVDSLEEDSLEEEDEEAEEVEEATAAKQLSSAAETSKSPDSSTA

SEQ ID NO: 3928 - protein, 56 aa, Human adenovirus B
AAMIQPPLEAPFVPPRYLAPTEGRNSIRYSELSPQYDTTKLYLVDNKSADIASLNY

SEQ ID NO: 3929 - protein, 56 aa, Human adenovirus B
KAWNSSTGQALRNKLKEQNFQQKVVDGIASGINGVVDLANQAVQKQINSRLDPPPA

SEQ ID NO: 3930 - protein, 56 aa, Human adenovirus B
MSKEIPTPYMWSYQPQMGLAAGASQDYSTRMNWLSAGPSMISRVNDIRAYRNQILL

SEQ ID NO: 3931 - protein, 56 aa, Human adenovirus B
MSHRRGSKKLKVQLSPPEDMKEDWDSQAEEEMEDWDSQAEEVDSLEEDSLEEEDEE

SEQ ID NO: 3932 - protein, 56 aa, Human adenovirus B
NTPLTKSNHSINLPIGNGLQIEQNKLCSKLGNGLTFDSSNSIALKNNTLWTGPKPE

SEQ ID NO: 3933 - protein, 56 aa, Human adenovirus B
MGDDPEPPVQLFEPPTLQELYDLEVEGSEDSNEEAVNGFFTDSMLLAANEGLELDP

SEQ ID NO: 3934 - protein, 56 aa, Human adenovirus B
KDITADNKPIYADKTYQPEPQVGEESWTGIDGTNEKFGGRALKPATKMKPCYGSFA

SEQ ID NO: 3935 - protein, 56 aa, Human adenovirus B
AILEAVVPSRSNPTHEKVLAIVNALVENKAIRPDEAGLVYNALLERVARYNSSNVQ

SEQ ID NO: 3936 - protein, 52 aa, Human adenovirus B
IQDVNRRVVAHASLLRAQYQNLPARGADVPLPAMPPGPEPPLPPGARPRHRF

SEQ ID NO: 3937 - protein, 56 aa, Human adenovirus B; identical to SEQ ID NO: 3929

SEQ ID NO: 3938 - protein, 56 aa, Human adenovirus B
MGDDPEPPVQPFDPPTLHDLYDLEVDGPEDPNEGAVNGFFTDSMLLAADEGLDINP

SEQ ID NO: 3939 - protein, 56 aa, Human adenovirus B
MAKRARLSTSFNPVYPYEDESSSQHPFINPGFISPDGFTQSPNGVLSLKCVNPLTT

SEQ ID NO: 3940 - protein, 56 aa, Human adenovirus B; identical to SEQ ID NO: 3933

SEQ ID NO: 3941 - protein, 56 aa, Human adenovirus B
TPGEIQVEEEIPPPEKRGDKRPRPDLEETLVTRVDEPPSYEEATKLGMPTTRPIAP

SEQ ID NO: 3942 - protein, 52 aa, Human adenovirus B
SGASAGRSRRQAAAVAAATIADMAQTRRGNVYWVRDAATGQRVPVRTRPPRT

SEQ ID NO: 3943 - protein, 56 aa, Human adenovirus B; identical to SEQ ID NO: 3927

SEQ ID NO: 3944 - protein, 56 aa, Human adenovirus B
MSQRRESKKLKVQPPPPEDMEEDWDSQAEEAEEEDSLEDSLEEDSLEEENEEAEEV

SEQ ID NO: 3945 - protein, 56 aa, Human adenovirus B
TGEKAVVKTTTVAVAEETSEDDNITRGDTYITEKQKREAAAAELLLMSEVKKELKI

SEQ ID NO: 3946 - protein, 56 aa, Human adenovirus B; identical to SEQ ID NO: 3931

SEQ ID NO: 3947 - protein, 56 aa, Human adenovirus B; identical to SEQ ID NO: 3927

SEQ ID NO: 3948 - protein, 56 aa, Human adenovirus B
PYLTGRLPSWAGVRQNVMGSTVDGRPVQPANSSTLTYATLSSSPLDPAAAAAAASV

SEQ ID NO: 3949 - protein, 56 aa, Human adenovirus B
TVSENVPALTDHGTLPLRSSIRGVQRVTVTDARRRTCPYVYKALGIVAPRVLSSRT

SEQ ID NO: 3950 - protein, 56 aa, Human adenovirus B
RYSELAPLYDTTRLYLVDNKSADIASLNYQNDHSNFLTTVVQNNDFTPTEASTQTI

SEQ ID NO: 3951 - protein, 56 aa, Human adenovirus B
ERSSATFKRSYDEVYGDDDILEQAADRLGEFAYGKRSRINPKDETVSIPLDHGNPT

SEQ ID NO: 3952 - protein, 56 aa, Human adenovirus B
STQHPVRVRGHFRAPWGALKGRTRVRTTVDDVIDEVVADARNYTPTAPTSTVDAVI

SEQ ID NO: 3953 - protein, 56 aa, Human adenovirus B
SKSRQSRQIKTAAATSNRKPAAAVRKYTTSAATGGLKITANEPAQTRELRNRIFPT

SEQ ID NO: 3954 - protein, 56 aa, Human adenovirus B
PPPGFYTGEYDMPDPNDGFLWDDVDSSIFSPPPGYTVWKKEGGDRRHSSVSLPGTA

SEQ ID NO: 3955 - protein, 56 aa, Human adenovirus B
NGVLSLKCVNPLTTASGSLQLKVGSGLTVDTTDGSLEENIKVNTPLTKSNHSINLP

SEQ ID NO: 3956 - protein, 56 aa, Human adenovirus B
MMRRTVLGGAVVYPEGPPPSYESVMQQAAAATMQPPLEAPFVPPRYLAPTEGRNSI

SEQ ID NO: 3957 - protein, 56 aa, Human adenovirus B
TISAPGRGAQRRPNSRWDETGRFPNPTTASKTGKKERQGYKSWPPTAVSKSRQPRQ

SEQ ID NO: 3958 - protein, 56 aa, Human adenovirus B
KAWNSSTGQALRNKLKDQNFQQKVVDGIASGINGVVDLANQAVQKKINSRLDPPPA

SEQ ID NO: 3959 - protein, 56 aa, Human adenovirus B
MAKRARLSSSFNPVYPYEDESSSQHPFINPGFISSNGFAQSPDGVLTLKCVNPLTT

SEQ ID NO: 3960 - protein, 56 aa, Human adenovirus B
FNPVYPYEDESTSQHPFINPGFISPNGFTQSPDGVLTLKCLTPLTTTGGSLQLKVG

SEQ ID NO: 3961 - protein, 49 aa, Human adenovirus B
QEQELKVKNRSLRSLTRSCLYHKSEDQLQRTLEDAEALFNKYCALTLKE

SEQ ID NO: 3962 - protein, 56 aa, Human adenovirus B
DEDNLRLLASAAFGCSGNPEASTGHASGSGGGTARGQPESRPGPSSGGGGVADLSP

SEQ ID NO: 3963 - protein, 51 aa, Human adenovirus B
QPRSGGIGTLQFVEEFTPSVYFNPFSGSPGQYPDEFIPNFDAISESVDGYD

SEQ ID NO: 3964 - protein, 56 aa, Human adenovirus B
QDNVKAEEIEADVEQDPGYVTPAEHEEELKRFLDREDDDRPEHQADGDHQEAGIGD

SEQ ID NO: 3965 - protein, 56 aa, Human adenovirus B
EEVTADKQLSSAAETSNSATISAPSRGTRRRPSSRWDETGRFPNPTSASKTGKKDR

SEQ ID NO: 3966 - protein, 56 aa, Human adenovirus B
PSLKPVTLQQVLPVTPRTGVKREGEDLYPTMQLMVPKRQKLEDVLEKVKVDPDIQP

SEQ ID NO: 3967 - protein, 50 aa, Human adenovirus B
PNALGYPQEPDEHIPLQHIQQPLALVQYENEPQPSLPPAISYFNLTGGDD

SEQ ID NO: 3968 - protein, 56 aa, Human adenovirus B
SSIESQVVLVSETSRSSLSPERSNSPPPIPPKKKPRKTKHVPLQDISQDSEEEREQ

SEQ ID NO: 3969 - protein, 56 aa, Human adenovirus B
NPGFISPDGFTQSPNGVLSLKCVNPLTTASGSLQLKVGSGLTVDTTDGSLEENIKV

SEQ ID NO: 3970 - protein, 56 aa, Human adenovirus B; identical to SEQ ID NO: 3933

SEQ ID NO: 3971 - protein, 56 aa, Human adenovirus B
YKYTPPNITLPTNTNTYEYMNGRVVSPSLVDSYINIGARWSLDPMDNVNPFNHHRN

SEQ ID NO: 3972 - protein, 56 aa, Human adenovirus B
ASGPLQLKVGSSLTVDTIDGSLEENITAAAPLTKTNHSIGLSIGSGLQTKDDKLCL

SEQ ID NO: 3973 - protein, 56 aa, Human adenovirus B
DPDVRIIENHGIEDELPNYCFPLNGIGPGHTYQGIKVKTDDTNGWEKDANVAPANE

SEQ ID NO: 3974 - protein, 31 aa, Human adenovirus B
CLYHKSEDQLQRTLEDAEALFNKYCALTLKE

SEQ ID NO: 3975 - protein, 56 aa, Human adenovirus B
MATGVMKPSQLHRPVTLDLPPPPAATAVPASKPVAAPKPVAVARSRPGGAPRPNAH

SEQ ID NO: 3976 - protein, 56 aa, Human adenovirus B
RRRPSSRWDETGRFPNPTSASKTAPTIASKSRQSRQIKTAAATSNRKPAAAVRKYT

SEQ ID NO: 3977 - protein, 56 aa, Human adenovirus B
METQPLLSTSPRVPSHLVLSDEEKEQSLSIPPPSPATTSTLEDKEVDASHDMQNKK

SEQ ID NO: 3978 - protein, 56 aa, Human adenovirus B
SGGGTARGQPESRPGPSSGGGGVADLSPELQRVLTGSTSTGRDRGVKRERASSGTD

SEQ ID NO: 3979 - protein, 56 aa, Human adenovirus B
AAATMQPPLEAPFVPPRYLAPTEGRNSIRYSELAPLYDTTRLYLVDNKSADIASLN

SEQ ID NO: 3980 - protein, 56 aa, Human adenovirus B
MRRRAVLGGAVVYPEGPPPSYESVMQQQAAMIQPPLEAPFVPPRYLAPTEGRNSIR

SEQ ID NO: 3981 - protein, 56 aa, Human adenovirus B; identical to SEQ ID NO: 3913

SEQ ID NO: 3982 - protein, 49 aa, Human adenovirus B
VYKYTPPNITLPTNTNTYEYMNGRVVSPSLVDSYINIGARWSLDPMDNV

SEQ ID NO: 3983 - protein, 56 aa, Human adenovirus B; identical to SEQ ID NO: 3944

SEQ ID NO: 3984 - protein, 56 aa, Human adenovirus B
STSGTDTVIYADKTFQPEPQVGNASWVDANGTEEKYGGRALKDTTKMKPCYGSFAK

SEQ ID NO: 3985 - protein, 56 aa, Human adenovirus B
LTPLTTTGGSLQLKVGGGLTIDDTDGFLKENISAATPLVKTGHSIGLSLGPGLGTN

SEQ ID NO: 3986 - protein, 56 aa, Human adenovirus B
TQSPDGVLTLKCLTPLTTTGGSLQLKVGGGLTIDDTDGFLKENISAATPLVKTGHS

SEQ ID NO: 3987 - protein, 56 aa, Human adenovirus B; identical to SEQ ID NO: 3920

SEQ ID NO: 3988 - protein, 56 aa, Human adenovirus B
RRRPSSRWDETGRFPNPTSASKTGKKDRQGYKSWRGHKNAIISCLHECGGNISFTR

SEQ ID NO: 3989 - protein, 56 aa, Human adenovirus B
EVQTEPAKPTATSTEVQTDPWMPMPITTDAAGPTRRSRRKYGPASLLMPNYVVHPS

SEQ ID NO: 3990 - protein, 56 aa, Human adenovirus B
THVFNRFPENQILIRPPAPTITTISENVPALTDHGTLPLRSSIRGVQRVTVTDARR

SEQ ID NO: 3991 - protein, 56 aa, Human adenovirus B
QSIKRLVIRGRGIQLNDESVSSSLGLRPDGVFQIAGCGRSSFTPRQAVLTLESSSS

SEQ ID NO: 3992 - protein, 50 aa, Human adenovirus B
GQEQELKVKNRSLRSLTRSCLYHKSEDQLQRTLEDAEALFNKYCALTLKE

SEQ ID NO: 3993 - protein, 56 aa, Human adenovirus B
EQSALTTTPRQHLNPRNWPAALVYQESPAPTTVLLPRDAQAEVQMTNAGAQLAGGS

SEQ ID NO: 3994 - protein, 56 aa, Human adenovirus B
RDAQAEVQMTNAGVQLAGGSALCRHRPQQSIKRLVIRGRGIQLNDESVSSSLGLRP

SEQ ID NO: 3995 - protein, 56 aa, Human adenovirus B
TGGPLQLKVGGGLIVDDTDGTLQENIRATAPITKNNHSVELSIGNGLETQNNKLCA

SEQ ID NO: 3996 - protein, 56 aa, Human adenovirus B
VMDHLLIKRARPLSENQNMQDPDASDEGKPVVSDEQLSRWLGTNSPRDLEERRKLM

SEQ ID NO: 3997 - protein, 56 aa, Human adenovirus B
SIPPPSPATTSTLEDKEVDASHDMQNKKAKESEPDIEQDPGYVTPVEHEEELKRFL

SEQ ID NO: 3998 - protein, 56 aa, Human adenovirus B
NSGNRGPVMTSTSSINSSKSWSGTLLPSLIPRCAMQPKHTLSQWRRDAVPTRQSIS

SEQ ID NO: 3999 - protein, 56 aa, Human adenovirus B
MSGSASFEGGVFSPYLTGRLPPWAGVRQNVMGSTVDGRPVQPANSSTLTYATLSSS

SEQ ID NO: 4000 - protein, 56 aa, Human adenovirus B
EDSNEEAVNGFFTDSMLLAANEGLELDPPLDTFDTPGVIVESGTGVRKLPDLGSVD

SEQ ID NO: 4001 - protein, 56 aa, Human adenovirus B
NPGFISSNGFAQSPDGVLTLKCVNPLTTASGPLQLKVGSSLTVDTIDGSLEENITA

SEQ ID NO: 4002 - protein, 55 aa, Human adenovirus B
SMWNQAVDSYDPDVRIIENHGIEDELPNYCFPLDGIGPGHRYQGIKVKTDDTNGW

SEQ ID NO: 4003 - protein, 56 aa, Human adenovirus B
LKRFLDREDDDRPEHQADGDHQEAGIGDQVADYLTGLGGEDVLLKHLARQSNIVKD

SEQ ID NO: 4004 - protein, 56 aa, Human adenovirus B
LIPRCAMQPKHTLSQWRRDAVPTRQSISSTCWALTVQKKTGFPSKSTGRITKNTFS

SEQ ID NO: 4005 - protein, 56 aa, Human adenovirus B
PLDTFDTPGVIVESGTGVRKLPDLGSVDCDLHCYEDGFPLSDEEDHEKEQFMQTAA

SEQ ID NO: 4006 - protein, 56 aa, Human adenovirus B
MTKRVRLSDSFNPVYPYEDESTSQHPFINPGFISPNGFTQSPDGVLTLNCLTPLTT

SEQ ID NO: 4007 - protein, 56 aa, Human adenovirus B
YPGITPDQARMMLIPIHCDCNHKPGCAPVMGRQTCKMTPFGMANAEDLDVATISDP

SEQ ID NO: 4008 - protein, 56 aa, Human adenovirus B
TTDRSQRLMLRFVPVDREDNTYSYKVRYTLAVGDNRVLDMASTFFDIRGVLDRGPS

SEQ ID NO: 4009 - protein, 56 aa, Human adenovirus B
FKPYSGTAYNSLAPKGAPNTSQWIVTTNGDNAVTTTTNTFGIASMKGGNITKEGLQ

SEQ ID NO: 4010 - protein, 56 aa, Human adenovirus B
GGLTIDDTDGFLKENISAATPLVKTGHSIGLSLGPGLGTNENKLCAKLGEGLTFNS

SEQ ID NO: 4011 - protein, 56 aa, Human adenovirus B
YEDLEGGNIPALLDVTAYEESKKDTTTETGEKAVVKTTTVAVAEETSEDDNITRGD

SEQ ID NO: 4012 - protein, 56 aa, Human adenovirus B
PLDTFDTPGVIVESGTGVRKLPDLGSVDCDLHCYEDGFPLSDEEDREKEQFMQTAA

SEQ ID NO: 4013 - protein, 56 aa, Human adenovirus B
TSQWIVTTNRDNAVTTTTNTFGIASMKGDNITKEGLQIGKDITTTEGEEKPIYADK

SEQ ID NO: 4014 - protein, 56 aa, Human adenovirus B
VQTEPAKPTTTSIEVQTDPWMTAPVTTPAAVNTTRRSRRKYGPASLLMPNYALHPS

SEQ ID NO: 4015 - protein, 56 aa, Human adenovirus B
EFAYGKRSRSSPKEEAVSIPLDNGNPTPSLKPVTLQQVLPVPPRRGNKREGEDLYP

SEQ ID NO: 4016 - protein, 56 aa, Human adenovirus B
SAGGAAGGQSESRPGPSGGGVADLFPELRRVLTRSTTSGQNRGIKRERNPSGNNSR

SEQ ID NO: 4017 - protein, 43 aa, Human adenovirus B
NRSRRRRRTSKPTPGALVRQVYRNSSAEPLTLPRARYHPSIIT

SEQ ID NO: 4018 - protein, 56 aa, Human adenovirus B
LPTPLYNPGFISPNGFTQSPDGVLTLKCLTPLTTTGGSLQLKVGGGLTIDDTDGFL

SEQ ID NO: 4019 - protein, 45 aa, Human adenovirus F
RARRQAARQAAAAIASMAQPRRGNIYWVRDASGVRVPVRSRPPRS

SEQ ID NO: 4020 - protein, 56 aa, Human adenovirus F
EGVLRCYHGLEMIQKEQLVEMDVASENAQRALKEHPSRAKVVQNRWGRSVVQLKND

SEQ ID NO: 4021 - protein, 56 aa, Human adenovirus F
LPGETDYLNDPLLQPVRNKNFPNNGVESLVDKMNRWKTYAQEQREWEESQSRPLAG

SEQ ID NO: 4022 - protein, 56 aa, Human adenovirus F
EEGVLRCFHGREMIQKEQVVEVDVGSENGQRALKEQPSKTKVVQNRWGRSVVQIKN

SEQ ID NO: 4023 - protein, 56 aa, Human adenovirus F
LQPTMQLMVPKRQKLEEVLENMKVDPSVEPEVKVRPIKEIGPGLGVQTVDIQIPVR

SEQ ID NO: 4024 - protein, 56 aa, Human adenovirus F
EPEVKVRPIKEIGPGLGVQTVDIQIPVRTTPAVAMAEAMETQTDQPAAVTTREIGL

SEQ ID NO: 4025 - protein, 56 aa, Human adenovirus F
NGALTLKLGTGLNIDENGDLSSDASVEVSAPITKTNKIVGLNYTKPLALRSNALTL

SEQ ID NO: 4026 - protein, 56 aa, Human adenovirus F
PSVEPEVKVRPIKEIGPGLGVQTVDIQIPVRASSSTVSTAVEAMETQPELPEAVAR

SEQ ID NO: 4027 - protein, 56 aa, Human adenovirus F
PPVALQQRPPPKVEEVEVEEKLPPLEVAPPLPSKGEKRPRPDLEETLVVESREPPS

SEQ ID NO: 4028 - protein, 56 aa, Human adenovirus F
ELAPLYDTTRVYLVDNKSADIASLNYQNDHSNFQTTVVQNNDFTPAEAGTQTINFD

SEQ ID NO: 4029 - protein, 56 aa, Human adenovirus F
LVDKMNRWKTYAQEQREWEESQSRPLAGPFSRWRRREDDQDDSADDNSVLDLGGTG

SEQ ID NO: 4030 - protein, 56 aa, Human adenovirus F
SQHPVRVRGHYRAPWGAYTRGVISRRTTVDDVIDSVVADAQRYTRPVATSTVDSVI

SEQ ID NO: 4031 - protein, 56 aa, Human adenovirus F
MSKDIPTPYMWSYQPQMGLAAGASQDYSSRMNWLSAGPHMIGRVNGIRATRNQILL

SEQ ID NO: 4032 - protein, 56 aa, Human adenovirus F
PPLPSKGEKRPRPDLEETLVVESREPPSYEQALKEGASPYPMTKPIGSMARPVYGK

SEQ ID NO: 4033 - protein, 56 aa, Human adenovirus F
PVRASSSTVSTAVEAMETQPELPEAVARAVAATREMGLQTDPWYEFVAPTSRPRSR

SEQ ID NO: 4034 - protein, 56 aa, Human adenovirus F
MRRAVGVPPVMAYAEGPPPSYESVMGSADSPATLEALYVPPRYLGPTEGRNSIRYS

SEQ ID NO: 4035 - protein, 56 aa, Human adenovirus F
KDELQPTMQLMVPKRQKLEEVLENMKVDPSVEPEVKVRPIKEIGPGLGVQTVDIQI

SEQ ID NO: 4036 - protein, 56 aa, Human adenovirus F
KKKLRKNVQVPDRVPVLPPSPEVVPDSEEEEEEVVYTGFSHPGVQVVQKASGKRYV

SEQ ID NO: 4037 - protein, 56 aa, Human adenovirus F
TLAVGDNRVLDMASTYFDIRGVLDRGPSFKPYSGTAYNSLAPKGAPNPSQWTNQNK

SEQ ID NO: 4038 - protein, 56 aa, Human adenovirus F
AQQIGEFAYGKRGRYGEVGLLLDQSNPTPSLKPATQQQILPVTETKRGVKRENKDE

SEQ ID NO: 4039 - protein, 56 aa, Human adenovirus F
RQSTAGAAPTATRAPRRRAATASPGEPPSTTASGRPPAANNVSLTPNSRLRGTIVA

SEQ ID NO: 4040 - protein, 56 aa, Human adenovirus F
PPFASSNGLQEKPPGVLSLKYTDPLTTKNGALTLKLGTGLNIDENGDLSSDASVEV

SEQ ID NO: 4041 - protein, 56 aa, Human adenovirus F
MPPKGNKHPIAQRQSQQKLQKQWDEEETWDDSQAEEVSDEEAEEQMESWDSLDEED

SEQ ID NO: 4042 - protein, 56 aa, Human adenovirus F
TAPNPCEWKDNNNKIKVRGQAPLIGTNIDKDNGIQIGTDATKPIYADKTYQPEPQV

SEQ ID NO: 4043 - protein, 56 aa, Human adenovirus F
FKPYSGTAYNSLAPKGAPNPSQWTNQNKTNSFGQAPYIGQKITNQGVQVGSDSNNR

SEQ ID NO: 4044 - protein, 56 aa, Human adenovirus F
MAGRQQELPTITPYLQETSPERAPSLPPKKKLRKNVQVPDRVPVLPPSPEVVPDSE

SEQ ID NO: 4045 - protein, 56 aa, Human adenovirus F
ILNPHWMPPSGFYTGEFDMPEGDDGFLWDDVSDSIFAPVRYRKKEGGDELPLPLVE

SEQ ID NO: 4046 - protein, 40 aa, Human adenovirus F
RTLRPWKDITLAPLDAHRLVPYSQSRPNPRNQEVCWIEMP

SEQ ID NO: 4047 - protein, 56 aa, Human adenovirus F
VDDVIDSVVADAQRYTRPVATSTVDSVIDSVVANARRYAQRKRRLQRRRRRPTAAM

SEQ ID NO: 4048 - protein, 56 aa, Human adenovirus F
DSPATLEALYVPPRYLGPTEGRNSIRYSELAPLYDTTRVYLVDNKSADIASLNYQN

SEQ ID NO: 4049 - protein, 56 aa, Human adenovirus F
KVRGQAPLIGTNIDKDNGIQIGTDATKPIYADKTYQPEPQVGQTQWNSEVGATDKV

SEQ ID NO: 4050 - protein, 56 aa, Human adenovirus F
NLLGIRKRLPFQEGFQIMYEDLEGGNIPALLDVTKYEASIQKAKEEGKEIGDDTFA

SEQ ID NO: 4051 - protein, 56 aa, Human adenovirus F
YEQALKEGASPYPMTKPIGSMARPVYGKESKPVTLELPPPVPTVPPMPAPTLGTAV

SEQ ID NO: 4052 - protein, 39 aa, Human adenovirus F
TLRPWKDITLAPLDAHRLVPYSQSRPNPRNQEVCWIEMP

SEQ ID NO: 4053 - protein, 38 aa, Human adenovirus F
VVFTPGERSVTRALKRDYDEVYADEDILEQAAQQVGEF

SEQ ID NO: 4054 - protein, 56 aa, Human adenovirus F
DALGDRSRYFSMWNQAVDSYDPDVRIIENHGVEDELPNYCFPLNGQGISNSYQGVK

SEQ ID NO: 4055 - protein, 56 aa, Human adenovirus F
YALVGTNLSLDSMKTPQIDELTSLSWIKQEDNPNKNLQSFFFIGQKLCEVTKDKIT

SEQ ID NO: 4056 - protein, 49 aa, Human adenovirus F
TKVNLQKAGKGGRQALMKLNFKGGVGGSVNSVEETLSSGGYNGSSEAEG

SEQ ID NO: 4057 - protein, 56 aa, Human adenovirus F
SEPNYLGGEDDVLLKHIARQSTIVREALKECTQTPLTVEELSRAYEANLFSPRVPP

SEQ ID NO: 4058 - protein, 56 aa, Human adenovirus F
VVFTPGERSVTRALKRDYDEVYADEDILEQAAQQVGEFAYGKRGRYGELGLLLDQS

SEQ ID NO: 4059 - protein, 56 aa, Human adenovirus F
EEAVDGMFPNWMLSEDHSADSGAASGDSGVGEDLVEVNLDLKCYEEGLPPSGSEAD

SEQ ID NO: 4060 - protein, 56 aa, Human adenovirus F
AVAATREMGLQTDPWYEFVAPTSRPRSRKYTTANSILPEYALHPSITPTPGYRGTT

SEQ ID NO: 4061 - protein, 56 aa, Human adenovirus F
EQNYDVSHPDNIFAKAASQGPIAIIMDECMENLGGHKGVSKFFHAFPSKLHDKFPK

SEQ ID NO: 4062 - protein, 56 aa, Human adenovirus F
TPGERSATRALKREYDEVYADEDILEQAAQQIGEFAYGKRGRYGEVGLLLDQSNPT

SEQ ID NO: 4063 - protein, 56 aa, Human adenovirus F
PEPSQAFEEISLHNLFDVELDESEGDPNEEAVDGMFPNWMLSEDHSADSGAASGDS

SEQ ID NO: 4064 - protein, 56 aa, Human adenovirus F
EQAAQQVGEFAYGKRGRYGELGLLLDQSNPTPSLKPATAQQILPVTEIKRGVKREN

SEQ ID NO: 4065 - protein, 56 aa, Papiine herpesvirus 2
AAAAPPTPAFAAALGSAALCDDDRAPQGRGAAPLSAEVGRPPRAPREPRTPREPRT

SEQ ID NO: 4066 - protein, 56 aa, Papiine herpesvirus 2
MEPPRPPDADSLLSDATSVIPLTPPAQGAEAYYTESDDETAADFLMRMGRQQTALR

SEQ ID NO: 4067 - protein, 30 aa, Papiine herpesvirus 2
ALVNASAATHVDVDVGRAADLFVSQMMGGR

SEQ ID NO: 4068 - protein, 56 aa, Papiine herpesvirus 2
PPHPGGVYHPGVLFPGPSPLEAQIAALVGAIAADRQPPPAAPGKRRRYETERECDH

SEQ ID NO: 4069 - protein, 56 aa, Papiine herpesvirus 2
AAAGPPTPAFAAAPGPAARCDDDRVPQGRGDAPPSAEVGRPPRAPREPRTPREPRV

SEQ ID NO: 4070 - protein, 56 aa, Papiine herpesvirus 2
RARRAARHAASPFARGTGGDDQTRPAAPAPASTPAPTPAPGSTPAPPSTPASAPAS

SEQ ID NO: 4071 - protein, 56 aa, Papiine herpesvirus 2
SGATGAVSGVAAPGAAAPAEAGDPEAHAALVNASAATHVDVDVGRAADLFVSQMMG

SEQ ID NO: 4072 - protein, 56 aa, Papiine herpesvirus 2
AQPRPPETPLPTPTPDSGESPAPPPEPQPPRPAADAAEPAPDDATRKALDALRERR

SEQ ID NO: 4073 - protein, 37 aa, Papiine herpesvirus 2
EPRCPREPRRPRDPRQPREPRTPRHYVQPPAPRGPRG

SEQ ID NO: 4074 - protein, 56 aa, Papiine herpesvirus 2
PTRRAARPAVGSLTSLADPPPPEPEPRPATPATPATPATPATPATPATPATPATPA

SEQ ID NO: 4075 - protein, 56 aa, Papiine herpesvirus 2
ATPATPATPATPATPATPATPATPATPATPATPATPATPATPATPATPATPATPPS

SEQ ID NO: 4076 - protein, 50 aa, Papiine herpesvirus 2
KRPPESPRRGKRRLSQTMVPSLTAISEETDAVAVPELSRSPRRPGPADAR

SEQ ID NO: 4077 - protein, 56 aa, Papiine herpesvirus 2
APTYIRLADDELYADLSSDGASDDSEYDSEDDRLPGTDRPPKRGSGFQILSGTKSD

SEQ ID NO: 4078 - protein, 43 aa, Papiine herpesvirus 2
LGDDDDDDRAGVPDDAAYASLDMADFEFEQMFTDALGIDEFGG

SEQ ID NO: 4079 - protein, 56 aa, Papiine herpesvirus 2
KYYTRSSDGRISPAVPVFVHEFVSNAPVYVHRDNVIAPAAPAPPRYRVPTRLADPK

SEQ ID NO: 4080 - protein, 56 aa, Papiine herpesvirus 2
RAAVAGRDATGRFTAARPRPVPLDADEASGAFYARFRDGYASGEPWPGAEPPPPGR

SEQ ID NO: 4081 - protein, 56 aa, Papiine herpesvirus 2
GAAAPTPAPPGDGSYLWIPAAHYNQLVASHPPGPAFGAPAAYAPLAGVVGAPAAFA

SEQ ID NO: 4082 - protein, 56 aa, Papiine herpesvirus 2
RIYRPPSPVAPSISAVNEAALARLGDELKRPPESPRRGKRRLSQTMVPSLTAISEE

SEQ ID NO: 4083 - protein, 34 aa, Papiine herpesvirus 2
RGLKTGMYYCKVRKATNSGVFGGDDNIVCTSCVL

SEQ ID NO: 4084 - protein, 56 aa, Papiine herpesvirus 2
PVYAEIKYAGESDVGRDDDDSEYTEGEPIYDEVASDVEEVTYARIQHRPRVVEEPI

SEQ ID NO: 4085 - protein, 56 aa, Papiine herpesvirus 2
PRLGRGANVRYRVRTRLGPDTAVPLPPREYRRAVLPALDGRAADSPARAAAAAGAP

SEQ ID NO: 4086 - protein, 56 aa, Papiine herpesvirus 2
GAIAADRQPPPAAPGKRRRYETERECDHDDRDDAAYYPGEARALPRFAPDAAGRAR

SEQ ID NO: 4087 - protein, 56 aa, Papiine herpesvirus 2
PEFRRRFLVGDAWRPLLEPELANPLTARLMAEYERRCRAEEVLPPREDVFSWTRYC

SEQ ID NO: 4088 - protein, 56 aa, Papiine herpesvirus 2
MSARRRRASASSRTPPAEDAEDEEVMDYDSDDGPGAGGTGIVGYLRSVFGGGDPDG

SEQ ID NO: 4089 - protein, 56 aa, Papiine herpesvirus 2
SHPPGPAFGAPAAYAPLAGVVGAPAAFAPPHPGGVYHPGVLFPGPSPLEAQIAALV

SEQ ID NO: 4090 - protein, 56 aa, Papiine herpesvirus 2
AAGPGVGPRSPPGPASSPPSARAAGAPGAPCRPVAPAAPLWRSVPAAWVSAANPLF

SEQ ID NO: 4091 - protein, 56 aa, Papiine herpesvirus 2
DPSPAADATPPGPKPGTGDGPYPPPPRRPAVTLPPPHLGPLTLRPPSPPTEPAPPS

SEQ ID NO: 4092 - protein, 56 aa, Papiine herpesvirus 2
PAFLCSAPGAKRPRRTEPGAPHANPWLGREPAAQARRGSFVTYTGELREEAPGADG

SEQ ID NO: 4093 - protein, 56 aa, Papiine herpesvirus 2
TRRRADELEAAAADLAEKIAARDARAGRERWAADVEAALDRVETRAEFDAVELRRL

SEQ ID NO: 4094 - protein, 56 aa, Papiine herpesvirus 2
TPATPATPATPATPATPATPATPATPPSAAAAADRASAPPATTTPPAGSSAAVATA

SEQ ID NO: 4095 - protein, 56 aa, Papiine herpesvirus 2
PAAPAPTPTPGPTPAPDSGEEAPDARPSSVPGGPAAAGGPDDEPADDEPPRPPSAF

SEQ ID NO: 4096 - protein, 56 aa, Papiine herpesvirus 2
AMAPRGQAFAALARDDWERITRDARLPAADVAAAVGAFPRDPGALGLRLTWRVHAR

SEQ ID NO: 4097 - protein, 56 aa, Papiine herpesvirus 2
LEDLSHALFPDNALETATRRALYKEVRLAVASRSGASSGTPVPPGCVNSEYSRTRQ

SEQ ID NO: 4098 - protein, 56 aa, Papiine herpesvirus 2
AGSLAGARGAKRTTVSEFVQVKHIDRVRRPDAPPGPPPPPAALPPAATPDDLWTVF

SEQ ID NO: 4099 - protein, 56 aa, Papiine herpesvirus 2
GSPPAGAAEALLDDLPIAEGDLARYASSVSLARMLYGGDLAEWVPRVHPRVTIERQ

SEQ ID NO: 4100 - protein, 56 aa, Papiine herpesvirus 2
EVAVVSFVAPPVRPGAMVSIATQTDPLPPAAPAPTPTPGPTPAPDSGEEAPDARPS

SEQ ID NO: 4101 - protein, 56 aa, Papiine herpesvirus 2
DTCLATILQMYMSVGAADKSADVLVAQAIRSMAESDVVMEDVAIAERALGLSGEPT

SEQ ID NO: 4102 - protein, 56 aa, Papiine herpesvirus 2
RTFVLGSVVDPRNRSAIEALRQAARYPHEDAGPEYHLSRAYAEIFGEAAPTEPGPR

SEQ ID NO: 4103 - protein, 56 aa, Papiine herpesvirus 2
AAEALALIGPPEMSEPLVLPGPPPGKRYRTFVLGSVVDPRNRSAIEALRQAARYPH

SEQ ID NO: 4104 - protein, 56 aa, Papiine herpesvirus 2
ASDGAPRARDLPSAAPERLEADMNPAAPGAAAPTPAPPGDGSYLWIPAAHYNQLVA

SEQ ID NO: 4105 - protein, 56 aa, Papiine herpesvirus 2
GTASDALPAANAPGSLASRLEREFAAFDWTSEEGSQPWLSSVVADTSSAERRRGDS

SEQ ID NO: 4106 - protein, 56 aa, Papiine herpesvirus 2
QNPSPAAGGATSAYYTRMDGPAAPHPPPRSRRTETLRSAPPAAAPPEDDPYLAPCD

SEQ ID NO: 4107 - protein, 56 aa, Papiine herpesvirus 2
RGAAPLSAEVGRPPRAPREPRTPREPRTPREPRVPRRPREPRDPREPRQPREPRTP

SEQ ID NO: 4108 - protein, 56 aa, Papiine herpesvirus 2
LCDLETRHACAHTTLMRLRGRHPRFASATRGPIGVFGTMNSAYSDCDVLGNYAAFS

SEQ ID NO: 4109 - protein, 20 aa, Papiine herpesvirus 2
RDRGPSRSRVRYTRLAASEA

SEQ ID NO: 4110 - protein, 56 aa, Papiine herpesvirus 2
DEGEQTPGETAASDISDAAVSPGTKRAPATVSVGASAPKKAREHPGDLGRVNPGPE

SEQ ID NO: 4111 - protein, 51 aa, Papiine herpesvirus 2
DFGAFGAEDDDAPAFGGFAAPAAGARKRAGAADDLFGDAPPDKRELTLDTL

SEQ ID NO: 4112 - protein, 56 aa, Papiine herpesvirus 2
LRSRAWVTHAPVWNPRSLVRPPVDPSGGAAPDAAPRPPAVPPPDAAPADAGPGTPV

SEQ ID NO: 4113 - protein, 56 aa, Papiine herpesvirus 2
DGGVIVGRQELDVLRYVADSSQTDVPCDLCDLETRHACAHTTLMRLRGRHPRFASA

SEQ ID NO: 4114 - protein, 56 aa, Human adenovirus D
SLLQPPRVKNAMANNGIESLVDKLNRWKTYAQDHREPAPAPRRQRHDRQRGLVWDD

SEQ ID NO: 4115 - protein, 56 aa, Human adenovirus D
TYAQDHREPAPAPRRQRHDRQRGLVWDDEDSADDSSVLDLGGSGGVNPFAHLQPKL

SEQ ID NO: 4116 - protein, 56 aa, Human adenovirus D
AATVVEMEDASAHPPPRGEKRPRPDAEETTLQVDEPPSYEEAVKAGMPTTRIIAPL

SEQ ID NO: 4117 - protein, 56 aa, Human adenovirus D
KQVAPGLGVQTVDIQIPTDMDVDKKPSTSIEVQTDPWLPASTATVSTSTAATATEP

SEQ ID NO: 4118 - protein, 56 aa, Human adenovirus D
MVPKRRRVEDVLDTVKMDVEPEVKVRPIKQVAPGLGVQTVDIQIPTDMDVDKKPST

SEQ ID NO: 4119 - protein, 56 aa, Human adenovirus D
TTLQVDEPPSYEEAVKAGMPTTRIIAPLATGVMKPATLDLPPPPAPAPPKAAPVVQ

SEQ ID NO: 4120 - protein, 56 aa, Human adenovirus D
PPRYMAPTEGRNSIRYSELAPLYDTTRVYLVDNKSADIASLNYQNDHSNFLTTVVQ

SEQ ID NO: 4121 - protein, 56 aa, Human adenovirus D
KDHVVEMDVTSENGQRALKEQPSKAKVTQNRWGRSVVQLTSHDARCCVQDAGCGNN

SEQ ID NO: 4122 - protein, 56 aa, Human adenovirus D
MPRKKPLVEEEVMEEEWDSQAEEDDWEEEESTEEEELEEVEEEQATEQPVAAPSAP

SEQ ID NO: 4123 - protein, 56 aa, Human adenovirus D
TIKNPQIKHSCDQQNLTLLNADKSHERTYLGYRHDSKGKVDYKVTVIPPPPATRKP

SEQ ID NO: 4124 - protein, 56 aa, Human adenovirus D
SCNQQNLTLLNADKSHERTYLGYRHDSKGKVDYKVTVIPPPSTTRKPLSQPHYVTV

SEQ ID NO: 4125 - protein, 56 aa, Human adenovirus D
MSKEIPTPYMWSYQPQMGLAAGASQDYSTRMNWLSAGPSMISRVNGVRSHRNQILL

SEQ ID NO: 4126 - protein, 56 aa, Human adenovirus D
SCDQQNLTLLNADKSHERTYLGYRHDSKGKVDYKVTVIPPPPTTRKPLSEPHYVTV

SEQ ID NO: 4127 - protein, 56 aa, Human adenovirus D
QQVLPQAVLLPSRGVKREGESMYPTMQIMVPKRRRVEDVLDTVKMDVEPEVKVRPI

SEQ ID NO: 4128 - protein, 56 aa, Human adenovirus D
SQQHPVRVRGHFRAPWGAYKRGRTSAPAAVRTTVDDVIDSVVADARNYTPAPSTVD

SEQ ID NO: 4129 - protein, 56 aa, Human adenovirus D; identical to SEQ ID NO: 4122

SEQ ID NO: 4130 - protein, 56 aa, Human adenovirus D
LDLPVTWYDGKGMQFCDGNTIKNPQIKHSCNQQNLTLLNADKSHERTYLGYRHDSK

SEQ ID NO: 4131 - protein, 56 aa, Human adenovirus D
YLGYRHDSKGKVDYKVTVIPPPPATRKPLSEPHYVTVSMGDNITLVGPSDLPVTWY

SEQ ID NO: 4132 - protein, 56 aa, Human adenovirus D
APNSSQWITKQTNAGNETTKTHTYGVAAMGGADITIKGLQIGVDKTENKNEPIYAN

SEQ ID NO: 4133 - protein, 56 aa, Human adenovirus D
QEGQKETSQKKANDKQKATHRRPSKLKPHTPEAKLITVSSGSNLTLLGPDGKVTWY

SEQ ID NO: 4134 - protein, 56 aa, Human adenovirus D; identical to SEQ ID NO: 4120

SEQ ID NO: 4135 - protein, 56 aa, Human adenovirus D
TDTTNGKQDPIYANKLYQPEPQVGEENWQETEAFYGGRALKKETKMKPCYGSFARP

SEQ ID NO: 4136 - protein, 56 aa, Human adenovirus D
LDLPVTWYDKKGMQFCIGNTIKNPQIKHSCDQQNLTLLNADKSHERTYLGYRHDSK

SEQ ID NO: 4137 - protein, 56 aa, Human adenovirus D
RAATAPTPAGRTRRRAAAAAAAAISSMTRPRRGNVYWVRDSVTGVRVPVRTRPPRP

SEQ ID NO: 4138 - protein, 56 aa, Human adenovirus D
APNSSQWLAKDTNAGDQALKTHTHGVAAMGGTDITAKGLQIGVDTTENKNEPIYAN

SEQ ID NO: 4139 - protein, 56 aa, Human adenovirus D
EESTEEEELEEVEEEQATEQPVAAPSAPAAPAVTDTTSAPAKPPRRWDRVKGDAKK

SEQ ID NO: 4140 - protein, 56 aa, Human adenovirus D
TFDKKGDLVAWNKENDRRTLWTTPDPSPNCKVSEEKDSKLTLVLTKCGSQILASVS

SEQ ID NO: 4141 - protein, 56 aa, Human adenovirus D
TPPFVSSDGFQNFPPGVLSLKLADPIAIANGNVSLKMGGGLTLQEGTGNLTVNTEP

SEQ ID NO: 4142 - protein, 56 aa, Human adenovirus D
TNGNVSLKVGGGLTVEQNSGNLKVNPKAPLQVATDNQLEISLADPFEVKNKKLSLK

SEQ ID NO: 4143 - protein, 42 aa, Human adenovirus D
VHRPTPVRPSGERRAAVEKIEDLLHDMGGDEPLDLSLKRPRN

SEQ ID NO: 4144 - protein, 56 aa, Human adenovirus D
NSSQWLAKDTNAGDQALKTHTHGVAAMGGTDITAKGLQIGVDTTENKNEPIYANEI

SEQ ID NO: 4145 - protein, 56 aa, Human adenovirus D
EESTEEEELEEVEEEQATEQPVAAPSAPAAPAVTDTTSAPAKPPRRWDRVKGDGKH

SEQ ID NO: 4146 - protein, 56 aa, Human adenovirus D
EDELHPSPFELGPTLQDLYDLEVDAHDDDPNEEAVNLIFPESLILQADIASEAVPT

SEQ ID NO: 4147 - protein, 36 aa, Human adenovirus D
WQKYDKVRKRIHYNANRGSVELAPPSSISQGPFTTI

SEQ ID NO: 4148 - protein, 56 aa, Human adenovirus D
TPPFVSSNGFQNFPPGVLSLKLADPITINNQNVSLKVGGGLTLQEETGKLTVNTEP

SEQ ID NO: 4149 - protein, 56 aa, Human adenovirus D
ILEAVVPSRTNPTHEKVLAIVNALAENKAIRPDEAGLVYNALLERVGRYNSTNVQS

SEQ ID NO: 4150 - protein, 56 aa, Human adenovirus D
TPPFVSSDGFQNFPPGVLSLKLADPIAITNGNVSLKVGGGLTVEQNSGNLKVNPKA

SEQ ID NO: 4151 - protein, 51 aa, Human adenovirus D
DLTDDTLLQVYRPTPVRPSGERRAAVDKIEDLLQDMGGDEPLDLSLKRPRN

SEQ ID NO: 4152 - protein, 56 aa, Human adenovirus D
ANGNVSLKMGGGLTLQEGTGNLTVNTEPPLQLTNNRIGIALDAPFDVIGGKLTLLA

SEQ ID NO: 4153 - protein, 56 aa, Human adenovirus D
EEDVVPVDTPPKLPKKQARKTKHVTKVDPDEEMPQEEDAVIVGVGFSQPPVLLKEG

SEQ ID NO: 4154 - protein, 56 aa, Human adenovirus D
SLHSLPGSVNSGRVSRPRLLGEDEYLNDSLLQPPRVKNAMANNGIESLVDKLNRWK

SEQ ID NO: 4155 - protein, 56 aa, Human adenovirus D
ASGINGVVDIANQAVQREINSRLDPRPPAATVVEMEDASAHPPPRGEKRPRPDAEE

SEQ ID NO: 4156 - protein, 56 aa, Human adenovirus D
FDIRGVLDRGPSFKPYSGTAYNSLAPKGAPNSSQWEQKKANAGDQKETHTYGVAPM

SEQ ID NO: 4157 - protein, 56 aa, Human adenovirus D
ANGDVSLKVGGGLTLQEGSLTVDPKAPLQLANNKKLELVYVDPFEVSANKLSLKVG

SEQ ID NO: 4158 - protein, 56 aa, Human adenovirus D
EDELHLSPFELGPTLQDLYDLEVNAQENDPNEEAVNLIFPESMILQADIASEAVPT

SEQ ID NO: 4159 - protein, 56 aa, Human adenovirus D
VKTLFQNGAGQSKVEQSNIGQGNKGKTTTAQSGGKKTKTEHRNQSPKRKSTNNLQP

SEQ ID NO: 4160 - protein, 56 aa, Human adenovirus D
KAWNSSTGQMLREKLADQNFQQKVVDGLASGINGVVDIANQAVQREINSRLDPRPP

SEQ ID NO: 4161 - protein, 44 aa, Human adenovirus D
ETFPETPVPKLVIPEFKWQPKYQYRNVALPSAAHNDERENPFDF

SEQ ID NO: 4162 - protein, 56 aa, Human adenovirus D
HPSPPDLTDDTLLQVYRPTPVRPSGERRAAVDKIEDLLQDMGGDEPLDLSLKRPRN

SEQ ID NO: 4163 - protein, 56 aa, Human adenovirus D
NNQNVSLKVGGGLTLQEETGKLTVNTEPPLHLTNNKLGIALDAPFDVIDNKLTLLA

SEQ ID NO: 4164 - protein, 36 aa, Human adenovirus D
WQKYDKVRKRIHYNANRDSIQLAPPSSISQGPFTTI

SEQ ID NO: 4165 - protein, 56 aa, Human adenovirus D
PYIGYNKEGTDREQYEVSVLDLMPIAGQGLDSKIKKEQKSLPKRKPKDKVKEVNFP

SEQ ID NO: 4166 - protein, 56 aa, Human adenovirus D; identical to SEQ ID NO: 4163

SEQ ID NO: 4167 - protein, 56 aa, Human adenovirus D
RSKRSYDEVYGDDDILDQAAERAGEFAYGKRSREEELISLPLDESNPTPSLKPVTL

SEQ ID NO: 4168 - protein, 56 aa, Human adenovirus D; identical to SEQ ID NO: 4163

SEQ ID NO: 4169 - protein, 48 aa, Human adenovirus D
NRRVVAHASALRAQHRDLPERHADVPLPPLPAGPEPPLPPGARPRHRF

SEQ ID NO: 4170 - protein, 56 aa, Human adenovirus D
KMYVSVPVPRYPGLGKSSNGERVRALDPALPLFIPWLPAVSGGRHPAGRVVQESHL

SEQ ID NO: 4171 - protein, 56 aa, Human adenovirus D
APNSSQWEQKKANAGDQKETHTYGVAPMGGENITISGLQIGTDTTNGKQDPIYANK

SEQ ID NO: 4172 - protein, 56 aa, Human adenovirus D
LYQPEPQVGEENWQETEAFYGGRALKKETKMKPCYGSFARPTNEKGGQAKLRDPEK

SEQ ID NO: 4173 - protein, 56 aa, Human adenovirus D
NALKETAEEEGHTSALVELEGDNARLAVLKRSVELTHFAYPAVNLPPKVMRRIMDQ

SEQ ID NO: 4174 - protein, 56 aa, Human adenovirus D
AGDQKETHTYGVAPMGGENITISGLQIGTDTTNGKQDPIYANKLYQPEPQVGEENW

SEQ ID NO: 4175 - protein, 56 aa, Human adenovirus D
VNGNVSLKVGGGLTLQDGTGKLTVNADPPLQLTNNKLGIALDAPFDVIDNKLTLLA

SEQ ID NO: 4176 - protein, 56 aa, Human adenovirus D
MSKRKIKEEMLQVVAPEIYGPPQADQKPRKIKRVKKKDEVDEGAVEFVREFAPRRR

SEQ ID NO: 4177 - protein, 56 aa, Human adenovirus D
KVEQGNTAQSGGKKTKTEHRNHSAKTKSTNNLQPTQLYVRPFTNVSLTGPPNGKVI

SEQ ID NO: 4178 - protein, 56 aa, Human adenovirus D
ETSQKKTNDTQKPSRRRPSKLKPNTPDTKLITATSGSNVTLVGPAGKVTWYDDDLK

SEQ ID NO: 4179 - protein, 56 aa, Human adenovirus D
MRRAVVSSSPPPSYESVMAQATLEVPFVPPRYMAPTEGRNSIRYSELAPLYDTTRV

SEQ ID NO: 4180 - protein, 56 aa, Human adenovirus D; identical to SEQ ID NO: 4146

SEQ ID NO: 4181 - protein, 56 aa, Human adenovirus D; identical to SEQ ID NO: 4179

SEQ ID NO: 4182 - protein, 56 aa, Human adenovirus D
MSQQQAPDPAIRAALQSQPSGLASDDWEAAMQRIMALTTRNPESFRQQPQANRLSA

SEQ ID NO: 4183 - protein, 56 aa, Human adenovirus D
TNSGVQLTGGASRCPLRPQSGIKIPVIRGKGTQLNDELGSSAIGLRPDGVFQLAGA

SEQ ID NO: 4184 - protein, 56 aa, Human adenovirus D
APNPSQWVAKENGQGTDKTHTYGSAAMGGSNITIEGLVIGTDEKAEDGKKDIFANK

SEQ ID NO: 4185 - protein, 56 aa, Human adenovirus D
TRMNWLSAGPSMISRVNGVRSHRNQILLEQAAVTSTPRAKLNPRNWPSTLVYQEIP

SEQ ID NO: 4186 - protein, 56 aa, Enterovirus A
SAIGNTIEALFQGPPKFRPIRISLEEKPAPDAISDLLASVDSEEVRQYCREQGWII

SEQ ID NO: 4187 - protein, 56 aa, Enterovirus A
YAIGNTIEALFQGPPKFRPIRISLEEKPAPDAISDLLASVDSEEVRQYCRDQGWII

SEQ ID NO: 4188 - protein, 56 aa, Enterovirus A
QVEPTAANTNASEHRLGTGLVPALQAAETGASSNAQDENLIETRCVLNHHSTQETT

SEQ ID NO: 4189 - protein, 56 aa, Enterovirus A
SAIGNTIEALFQGPLKFKPIRISLEEKPAPDAISDLLASVDSEEVRQYCREQGWII

SEQ ID NO: 4190 - protein, 56 aa, Enterovirus A
QVLPTAADTEASSHRLGTGVVPALQAAETGASSNASDKNLIETRCVLNHHSTQETA

SEQ ID NO: 4191 - protein, 56 aa, Enterovirus A
VKPNKETGRLNINGPTRTKLEPSVFHDVFEGNKEPAVLHSRDPRLEVDFEQALFSK

SEQ ID NO: 4192 - protein, 56 aa, Enterovirus A
LPAPTGPDTQVSSHRLDTGKVPALQAAEIGASSNASDESMIETRCVLNSHSTAETT

SEQ ID NO: 4193 - protein, 56 aa, Enterovirus A
FEGNKEPAVLHSRDPRLEVDFEQALFSKYVGNTLHEPDEYIKEAALHYANQLKQLD

SEQ ID NO: 4194 - protein, 56 aa, Enterovirus A
GVVGIASTGGNGLVGFADVRDLLWLDEEAMEQGVSDYIKGLGDAFGTGFTDAVSRE

SEQ ID NO: 4195 - protein, 56 aa, Enterovirus A
MKPNRETGRLNINGPTRTKLEPSVFHDVFEGNKEPAVLTSKDPRLEVDFEQALFSK

SEQ ID NO: 4196 - protein, 56 aa, Enterovirus A
TATIQGDRVADVIESSIGDSVSKALTPALPAPTGPDTQVSSHRLDTGKVPALQAAE

SEQ ID NO: 4197 - protein, 56 aa, Enterovirus A
MKPNKETGRLNINGPTRTKLEPSVFHDVFEGNKEPAVLTSKDPRLEVDFEQALFSK

SEQ ID NO: 4198 - protein, 56 aa, Enterovirus A
AMEQGVSDYIKGLGDAFGTGFTDAVSREVEALKNHLIGSEGAVEKILKNLIKLISA

SEQ ID NO: 4199 - protein, 56 aa, Enterovirus A
VKSNKETGRLNINGPTRTKLEPSVFHDVFEANKEPAVLTSKDPRLEVDFEQALFSK

SEQ ID NO: 4200 - protein, 56 aa, Enterovirus A
FEGNKEPAVLTSKDPRLEVDFEQALFSKYVGNTLHEPDEYVTQAALHYANQLKQLD

SEQ ID NO: 4201 - protein, 56 aa, Enterovirus A
AMEQGVSDYIKGLGDAFGVGFTDAVSREVEALKNHLIGSEGAVEKILKNLVKLISA

SEQ ID NO: 4202 - protein, 56 aa, Enterovirus A
AMEQGVSDYIKGLGRAFGTGFTDAVSREVEALKNHLIGSEGAVEKILKNLVKLISA

SEQ ID NO: 4203 - protein, 56 aa, Enterovirus A
YPYSALGIKKRDILDPATRDVSKMKSYMDKYGLDLPYSTYVKDELRSLDKIKKGKS

SEQ ID NO: 4204 - protein, 56 aa, Enterovirus A
FEANKEPAVLTSKDPRLEVDFEQALFSKYVGNVLHEPDEYVHQAALHYANQLKQLD

SEQ ID NO: 4205 - protein, 56 aa, Enterovirus A
YPYSALGIKKRDILDPTTRDVSKMKFYMDKYGLDLPYSTYVKDELRSIDKIKKGKS

SEQ ID NO: 4206 - protein, 56 aa, Enterovirus A
AMEQGVSDYIKGLGDAFGTGFTDAVSREVEALRNHLIGSDGAVEKILKNLIKLISA

SEQ ID NO: 4207 - protein, 56 aa, Enterovirus A
YHSSVYSLPPDPDHFDGYKQQVVTVMDDLCQNPDGKDMSLFCQMVSTVDFIPPMAS

SEQ ID NO: 4208 - protein, 56 aa, Enterovirus A
GVVGIVSTGGNGLVGFADVRDLLWLDEEAMEQGVSDYIKGLGDAFGTGFTDAVSRE

SEQ ID NO: 4209 - protein, 56 aa, Enterovirus A
DKYGLDLPNSTYVKDELSSLDKIRKGESRLIEASSLNDPVYPRLTFGHLYEVFHAN

SEQ ID NO: 4210 - protein, 56 aa, Enterovirus A
LTIGNSTITTQEAANIIIAYGEWPEYCKDADATAVDKPTRPDVSVNRFFTLDTKSW

SEQ ID NO: 4211 - protein, 56 aa, Enterovirus A
LTIGNSTITTQEAANIIVGYGEWPSYCSDNDATAVDKPTRPDVSVNRFYTLDTKLW

SEQ ID NO: 4212 - protein, 56 aa, Enterovirus A
SANIQGDGIADMIDQAVTSRVGRALTSLQVEPTAANTNASEHRLGTGLVPALQAAE

SEQ ID NO: 4213 - protein, 56 aa, Enterovirus A
YPYSALGVKKRDILDPITRDTTKMKFYMDKYGLDLPYSTYVKDELRSLDKIKKGKS

SEQ ID NO: 4214 - protein, 56 aa, Enterovirus A
TASIQGDRVADVIESSIGDSVSRALTQALPAPTGQNTQVSSHRLDTGEVPALQAAE

SEQ ID NO: 4215 - protein, 56 aa, Enterovirus A
NTEHMPSMFVPVGDVVQYGFLNLSGKPTHRTMMYNFPTKAGQCGGVVTSVGKIIGI

SEQ ID NO: 4216 - protein, 56 aa, Enterovirus A
IQLRDRKSKVRYSIDTVVSELIREYNNRSAIGNTIEALFQGPLKFKPIRISLEEKP

SEQ ID NO: 4217 - protein, 56 aa, Enterovirus A
YPYSALGIKKRDILDPVTRDTSRMKLYMDKYGLDLPNSTYVKDELSSLDKIRKGES

SEQ ID NO: 4218 - protein, 56 aa, Enterovirus A
TANIQGDPIADMIDQTVNNQVNRSLTALQVLPTAADTEASSHRLGTGVVPALQAAE

SEQ ID NO: 4219 - protein, 56 aa, Enterovirus A
GVVGIVSTGGNGLVGFADVRDLLWLDEEAMEQGVSDYIKGLGDAFGVGFTDAVSRE

SEQ ID NO: 4220 - protein, 56 aa, Enterovirus A
IQLRDRKSKVRYSVDTVVSELIREYNSRSAIGNTIEALFQGPPKFRPIRISLEEKP

SEQ ID NO: 4221 - protein, 56 aa, Enterovirus A
IQLRDRKSKVRYSVDTVVSELIREYNNRSAIGNTIEALFQGPPKFRPIRISLEEKP

SEQ ID NO: 4222 - protein, 56 aa, Enterovirus A
DKYGLDLPYSTYVKDELRSLDKIKKGKSRLIEASSLNDSVYLRMTFGHLYEVFHAN

SEQ ID NO: 4223 - protein, 56 aa, Enterovirus A
GVVGIVSTGGSGLVGFADVRDLLWLDEEAMEQGVSDYIKGLGRAFGTGFTDAVSRE

SEQ ID NO: 4224 - protein, 37 aa, Enterovirus A
GKDEYEKFVSTIRSVPVGKALAIPNFENLRRNWLELF

SEQ ID NO: 4225 - protein, 56 aa, Enterovirus A
DAGRAAKLCSENNTANFKRCSPLVCGKAIQLRDRKSKVRYSVDTVVSELIREYNSR

SEQ ID NO: 4226 - protein, 56 aa, Enterovirus A
IQLRDRKSKVRYSVDTVVSELIREYNNRYAIGNTIEALFQGPPKFRPIRISLEEKP

SEQ ID NO: 4227 - protein, 56 aa, Enterovirus A
INTKKMSMEEACYGTDNLEAIDLHTSAGYPYSALGIKKRDILDPATRDVSKMKSYM

SEQ ID NO: 4228 - protein, 56 aa, Enterovirus A
DDDATAVDKPTRPDVSVNRFYTLDTKLWEKSSKGWYWKFPDVLTETGVFGQNAQFH

SEQ ID NO: 4229 - protein, 56 aa, Enterovirus A
LDTNEKFRDITKCIPEVITGASDATLVINTEHIPSMFVPVGDVVQYGFLNLSGKPT

SEQ ID NO: 4230 - protein, 56 aa, Enterovirus A
APDAISDLLASVDSEEVRQYCRDQGWIIPETPTNVERHLNRAVLIMQSIATVVAVV

SEQ ID NO: 4231 - protein, 56 aa, Enterovirus A
TTAYIVALAAAQDNFTMKLCKDTEDIEQTANIQGDPIADMIDQTVNNQVNRSLTAL

SEQ ID NO: 4232 - protein, 56 aa, Enterovirus A
LPAPTGQNTQVSSHRLDTGEVPALQAAEIGASSNTSDESMIETRCVLNSHSTAETT

SEQ ID NO: 4233 - protein, 56 aa, Enterovirus A
DAGRAAKLCTENNTANFKRCSPLVCGKAIQLRDRKSKVRYSVDTVVSELIREYNNR

SEQ ID NO: 4234 - protein, 37 aa, Enterovirus A
GKQEYEKFVSTIRSVPVGKALAIPNYENLRRNWLELF

SEQ ID NO: 4235 - protein, 56 aa, Mamastrovirus 1
TETDTESEEDEDEDDEADRFDLHSSYGSEPEDDDESNRVTLLSTLINQGMTVERAT

SEQ ID NO: 4236 - protein, 56 aa, Mamastrovirus 1
SDFESTEDENDEVDRFDLHPSSESDDDDVENDRATLLSTLLNQGISVERATRITNG

SEQ ID NO: 4237 - protein, 56 aa, Mamastrovirus 1
DSDFESTEDETDEVDRFDLHLSSESDDDDVENNRVTLLSTLINQGMSVERATRITS

SEQ ID NO: 4238 - protein, 56 aa, Mamastrovirus 1
EDIETDTDIESTEDEDEADRFDIIDTSDEEDENETDRVTLLSTLVNQGMTMTRATR

SEQ ID NO: 4239 - protein, 56 aa, Mamastrovirus 1
FDLHSPYSSEPEDSDENNRVTLLSTLINQGMTVERATRITKRAFPTCAEKLKRSVY

SEQ ID NO: 4240 - protein, 56 aa, Mamastrovirus 1
DFADQLREDIETDTDIESTEDEDDEADRFDIIDTSDEEDENETDRVTLLSTLVNQG

SEQ ID NO: 4241 - protein, 56 aa, Mamastrovirus 1
DVENNRVTLLSTLINQGMSVERATRITSNAFPTRAARLRRSVYNDLLVSGLGPDAA

SEQ ID NO: 4242 - protein, 32 aa, Mamastrovirus 1
SPSSISWSGLGGRKHMDVTVGRNAVFKLRPSD

SEQ ID NO: 4243 - protein, 56 aa, Mamastrovirus 1
DDDDVENDRATLLSTLLNQGISVERATRITNGAFPARAARMRRSVYNDLLVSGLSP

SEQ ID NO: 4244 - protein, 56 aa, Mamastrovirus 1
DEADRFDLCYTSDSEDDIENNRVTLLSTLINQGMTVDRATMITNRAFPTPNHRSRR

SEQ ID NO: 4245 - protein, 56 aa, Mamastrovirus 1
VETAEVDRFDLHSSSESDDDDVENDRATLLSTLLNQGISVERATRITNGAFPTRAA

SEQ ID NO: 4246 - protein, 56 aa, Mamastrovirus 1
TSTSWSGLGARKHLDVTVGKNATFKLKPSDLGGPRDGWWLTNTNDNASDTLGPSIE

SEQ ID NO: 4247 - protein, 44 aa, Mamastrovirus 1
TPSSTSWSGLGARKHLDVTVGKNAVFKLKPADLGGPRDGWWLHK

SEQ ID NO: 4248 - protein, 56 aa, Mamastrovirus 1
SDSRVFLEETDYEDEEDEDEDDEADRFDLHSSYGSEPEDDDENNRVTLLSTLINQG

SEQ ID NO: 4249 - protein, 56 aa, Mamastrovirus 1
DEDDCENVSEETETEDEEDEDEDDEADRFDLHSPYSSEPEDSDENNRVTLLSTLIN

SEQ ID NO: 4250 - protein, 56 aa, Mamastrovirus 1
NVRLTSMVGASAVDGTVVRISLNPTSTPSSTSWSGLGARKHLDVTVGKNAVFKLKP

SEQ ID NO: 4251 - protein, 56 aa, Mamastrovirus 1
LHSSYGSEPEDDDENNRVTLLSTLINQGMTVERATRITKRAFPTSADKTKRSVYMD

SEQ ID NO: 4252 - protein, 56 aa, Mamastrovirus 1
NVRLTSMVGASAVNGTVVRVSLNPTSTPSSTSWSGLGARKHLDVTVGKNAIFKLKP

SEQ ID NO: 4253 - protein, 56 aa, Mamastrovirus 1
NVKLTSMVGASAVNGTVSGVSLNPTTTPTSTSWSGLGARKHLDVTVGKNATFKLKP

SEQ ID NO: 4254 - protein, 56 aa, Mamastrovirus 1
DLHSPYGSEPEDSDENNRVTLLSTLINQGMTVERATRITKRAFPTCADKMKRSVYM

SEQ ID NO: 4255 - protein, 56 aa, Mamastrovirus 1
SSTSWSGLGARKHLDVTVGKNAIFKLKPSDLGGPRDGWWLTNTNDNASDTLGPSVE

SEQ ID NO: 4256 - protein, 53 aa, Mamastrovirus 1
NVKLTSMVGASAVNGTVLRVSLNPTSTPSSTSWSGLGARKHLDVTVGKNATFN

SEQ ID NO: 4257 - protein, 56 aa, Mamastrovirus 1
FDIIDTSDEEDENETDRVTLLSTLVNQGMTMTRATRIARRAFPTLTDKIKRGVYMD

SEQ ID NO: 4258 - protein, 56 aa, Mamastrovirus 1
SSTSWSGLGARKHMDVTVGRNAVFKLRPSDLGGPRDGWWLTNTNDNASDTLGPSIE

SEQ ID NO: 4259 - protein, 56 aa, Mamastrovirus 1
NVRLTSMVGASAVNGTVVRISLNPTSTPSSTSWSGLGARKHLDVTVGKNALFKLKP

SEQ ID NO: 4260 - protein, 56 aa, Mamastrovirus 1
SPYGSEPEDSDENNRVTLLSTLINQGMTVERATRITKRAFPTCAEKTKRSIYMDLL

SEQ ID NO: 4261 - protein, 56 aa, Mamastrovirus 1
EETDSDFESTEDENDEVDRFDLHPSSESDDDDVENDRATLLSTLLNQGISVERATR

SEQ ID NO: 4262 - protein, 56 aa, Mamastrovirus 1
EEETEYETESDEDETDEVDRFDLCCTSDSEDDIENNRVTLLSTLINQGVTVDRATM

SEQ ID NO: 4263 - protein, 56 aa, Mamastrovirus 1
LHLSSESDDDDVENNRVTLLSTLINQGMSVERATRITSNAFPTRAARLRRSVYNDL

SEQ ID NO: 4264 - protein, 56 aa, Mamastrovirus 1
NVKLTSMVGASAVNGTVLRISLNPTSTPSSTSWSGLGARKHMDVTVGRNALFKLRP

SEQ ID NO: 4265 - protein, 56 aa, Mamastrovirus 1
TLINQGMAVERATRITNNAFPTRATRLRRSVYNDLLVSGPGPDAAWSHACEQARKV

SEQ ID NO: 4266 - protein, 56 aa, Mamastrovirus 1
SSTSWSGLGARKHLDVTVGKNAVFKLKPSDLGGPRDGWWLTNTNDNASDTLGPSIE

SEQ ID NO: 4267 - protein, 56 aa, Mamastrovirus 1
TEYVSEETETEDEEDEDEDDEADRFDLHSPYGSEPEDSDENNRVTLLSTLINQGMT

SEQ ID NO: 4268 - protein, 41 aa, Mamastrovirus 1
STSWSGLGARKHLDVTVGKNAVFKLKPADLGGPRDGWWLTN

SEQ ID NO: 4269 - protein, 56 aa, Mamastrovirus 1
NVKLTSMVGASAVNGTVLRISLNPTSTPSSTSWSGLGARKHMDVTVGRNAVFKLRP

SEQ ID NO: 4270 - protein, 56 aa, Mamastrovirus 1
STSWSGLGARKHLDVTVGKNAVFKLKPADLGGPRDGWWLTNTNDNASDTLGPSIEI

SEQ ID NO: 4271 - protein, 56 aa, Mamastrovirus 1
NVRLTSMVGASAVNGTVVRISLNPTSTPSSTSWSGLGARKHLDVTVGKNAAFKLKP

SEQ ID NO: 4272 - protein, 56 aa, Mamastrovirus 1
VKLTSMVGSSAVNGTVVRVSLNPTSTPSSTSWSGLGARKHLDVTVGKNAVFKLKPA

SEQ ID NO: 4273 - protein, 56 aa, Mamastrovirus 1
AVNGTVLRVSLNPTSTPSSTSWSGLGARKHLDVTVGKNATFKLKPSDLGGPRDGWW

SEQ ID NO: 4274 - protein, 56 aa, Mamastrovirus 1
TPSSTSWSGLGARKHLDVTVGKNAVFKLKPADLGGPRDGWWLTNTNDNASDTLGPS

SEQ ID NO: 4275 - protein, 56 aa, Mamastrovirus 1
PSSTSWSGLGARKHLDVTVGKNAVFRLKPADLGGPRDGWWLTNTNDNASDTLGPSI

SEQ ID NO: 4276 - protein, 56 aa, Mamastrovirus 1; identical to SEQ ID NO: 4252

SEQ ID NO: 4277 - protein, 56 aa, Mamastrovirus 1
SEDDIENNRVTLLSTLINQGVTVDRATMITNRAFPTPNYKPRREPSNDLLAPSDCL

SEQ ID NO: 4278 - protein, 56 aa, Mamastrovirus 1
SSTSWSGLGARKHLDVTVGKNATFKLKPSAIGGDQLLLQGGHHPDLGLSFYTNLFK

SEQ ID NO: 4279 - protein, 56 aa, Mamastrovirus 1
NVKLTSMVGASAVNGTVLRVSLNPTSTPSSTSWSGLGARKHLDVTVGKNATFKLKP

SEQ ID NO: 4280 - protein, 56 aa, Mamastrovirus 1; identical to SEQ ID NO: 4266

SEQ ID NO: 4281 - protein, 56 aa, Mamastrovirus 1
YLKVKRTSMVGAHAVNGTVLRVSLNPTSTPSSTSWPGLGARNHLDVTGGKNATFKL

SEQ ID NO: 4282 - protein, 56 aa, Mamastrovirus 1
SSTSWSGLGARKHMDVTVGRNALFKLRPSDFGGPRDGWWLTNTNDNASDPLGPSIE

SEQ ID NO: 4283 - protein, 32 aa, Mamastrovirus 1
TPSSTSWPGLGARNHLDVTGGKNATFKLKPSD

SEQ ID NO: 4284 - protein, 56 aa, Mamastrovirus 1
SYGSEPEDDDENNRVTLLSTLINQGMTVERATMITKRAFPTCADKQKRSVHMDLLA

SEQ ID NO: 4285 - protein, 56 aa, Mamastrovirus 1
NVRLTSMVGASAVNGTVVRISLNPTSTPSSTSWSGLGARKHLDVTVGKNAVFKLKP

SEQ ID NO: 4286 - protein, 56 aa, Mamastrovirus 1; identical to SEQ ID NO: 4272

SEQ ID NO: 4287 - protein, 56 aa, Mamastrovirus 1
WELPTETDTESEEDEDEDDEADRFDLHSSYGSEPEDDDENNRVTLLSTLINQGMTV

SEQ ID NO: 4288 - protein, 42 aa, Mamastrovirus 1
SSTSWSGLGARKHLDVTVGKNAAFKLKPSDLGGPRDGWWLTN

SEQ ID NO: 4289 - protein, 56 aa, Mamastrovirus 1
EPEDDDESNRVTLLSTLINQGMTVERATMITKRAFPTCADKQKRSVHMDLLASGLS

SEQ ID NO: 4290 - protein, 56 aa, Mamastrovirus 1
LLSTLLNQGISVERATRITNGAFPTRAARMRRSVYNDLLVSGLSPGAAWSHACEQA

SEQ ID NO: 4291 - protein, 56 aa, Mamastrovirus 1
GQALFSAEETDSDFESTEDETDEVDRFDLHLSSESDDDDVENNRVTLLSTLINQGM

SEQ ID NO: 4292 - protein, 56 aa, Mamastrovirus 1
SVERATRITSNAFPTRAARLRRSVYNDLLVSGHGPDTAWSHVCEQARKVGDNHDLQ

SEQ ID NO: 4293 - protein, 55 aa, Mamastrovirus 1
NAFPTRAARLRRSVYNDLLVSGLGPDAAWSHACEQARKVGDNHDLQASGSRGHAE

SEQ ID NO: 4294 - protein, 56 aa, Mamastrovirus 1
SSTSWSGLGARKHLDVTVGKNAIFKLKPSDLGGPRDGWWLTKHNGNASDTLGPSVE

SEQ ID NO: 4295 - protein, 56 aa, Mamastrovirus 1
SSTSWSGLGARKHLDVTVGKNALFKLKPPDLGGPRDGWWLTNTIDNASDTLGPSIE

SEQ ID NO: 4296 - protein, 56 aa, Mamastrovirus 1
EDEDDEADRFDIIDTSDEEDENETDRVTLLSTLINQGMTMTRATKIARRAFPTLSD

SEQ ID NO: 4297 - protein, 56 aa, Mamastrovirus 1
YEMLTSIPRSRAAGYGYDSDNTEYLDAPDFADQLREDIETDTDIESTEDEDDEADR

SEQ ID NO: 4298 - protein, 56 aa, Mamastrovirus 1
YLNVKLTSMVGASAVNGTVVRVSLNPTSTPSSTSWSGLGARKHLDVTVGKNAVFKL

SEQ ID NO: 4299 - protein, 56 aa, Mamastrovirus 1
VENDRATLLSTLLNQGISVERATRITNGAFPTRAARVRRSVYNDLLVSGLSPGAAW

SEQ ID NO: 4300 - protein, 56 aa, Mamastrovirus 1
PRSRASGHGYESDNTEYLDAPDSADQFKEDIETDTDIESTEDEDEADRFDIIDTSD

SEQ ID NO: 4301 - protein, 56 aa, Mamastrovirus 1
PQARSEEPETYVDAPLPEEPPIEEEETDSDFESTEDENDEVDRFDLHPSSESDDDD

SEQ ID NO: 4302 - protein, 56 aa, Mamastrovirus 1
SNQRVRKIVNKQLRKQGVTGPKPAICQTATATLGTIGSNTTGATEIEACILLNPVL

SEQ ID NO: 4303 - protein, 56 aa, Mamastrovirus 1
TMQGFTPVESVSWYTADFQPSDEPSPIPGLYARVNNTKKADVYGVQQFKSSHTNNR

SEQ ID NO: 4304 - protein, 56 aa, Mamastrovirus 1
WCFTGYAANPNLVNLVTSSDKQVNVTFEGSAGTPLVMNVPAASHFARTVAQRSTLP

SEQ ID NO: 4305 - protein, 56 aa, Mamastrovirus 1
TMQGFTSIASVDWYTIDFQPSEAPAPIQGLQVLVNSSKKADVYAIKQFVTAQTNNK

SEQ ID NO: 4306 - protein, 56 aa, Mamastrovirus 1
EEDENETDRVTLLSTLVNQGMTMTRATRIARRAFPTLSDRIKRGVYMDLLVSGASP

SEQ ID NO: 4307 - protein, 56 aa, Mamastrovirus 1
LNVKLTSMVGSSAVNGTAVRISLNPTSTPSSTSWSGLGARKHLDVTVGKNAVFRLK

SEQ ID NO: 4308 - protein, 56 aa, Mamastrovirus 1; identical to SEQ ID NO: 4302

SEQ ID NO: 4309 - protein, 56 aa, Mamastrovirus 1
PPALFKHIKEIRWNFINKDQREKYRHVHEWYVDNLLNRHVLLPSGEVTLQTRGNPS

SEQ ID NO: 4310 - protein, 56 aa, Mamastrovirus 1
EDDDAYVSEGTETEDEEDEDEDDEADRFDLHSPYGSEPEDSDENNRVTLLSTLINQ

SEQ ID NO: 4311 - protein, 56 aa, Mamastrovirus 1
HTVLPQARSEEPETYVDALLPVEPSIEEEETDSDFESTEDENDEVDRFDLHPSSES

SEQ ID NO: 4312 - protein, 56 aa, Mamastrovirus 1
DNIEYLDALDSADQFEENIETDIDTESTEDEDDEADRFDIIDTSDEEDENETDRVT

SEQ ID NO: 4313 - protein, 56 aa, Mamastrovirus 1
EWYVDNLLNRHVLLPSGEVTLQTRGNPSGQFSTPMDNNMVNFWLQAFEFAYFNGPD

SEQ ID NO: 4314 - protein, 56 aa, Mamastrovirus 1
RFDLCCTSDSEDDISDENNRVTLLSTLINQGMTVDRATMITNRAFPTPNYKPRREP

SEQ ID NO: 4315 - protein, 56 aa, Mamastrovirus 1
SNQRVRKIVNKQLRKPSFTGPKPCICETATATLGTIGSNTTGATEIEACILLNPVL

SEQ ID NO: 4316 - protein, 56 aa, Mamastrovirus 1
PQSRARSIGLEEDQTDNWQEPDEDLQTSTEESDYETDSLEDESDDEDSNTCRELVI

SEQ ID NO: 4317 - protein, 37 aa, Mamastrovirus 1
LVSGHGPDTAWSHVCEQARKVGDNHDLQVSGSRGHAE

SEQ ID NO: 4318 - protein, 56 aa, Mamastrovirus 1
ATLGRAIPSPGDTFNVVLTIGQPLAPNTLTKQSWLNKTTVSPQNHHVVKIAKDVNN

SEQ ID NO: 4319 - protein, 56 aa, Mamastrovirus 1
QEPDEDLQTSTEESDYETDSLEDESDDEDTNTCRELVINTLVNQGISRERAMYIGM

SEQ ID NO: 4320 - protein, 56 aa, Mamastrovirus 1
RKKPTPAPRIFKPKLAPAPVTEVQPLDLSCKQQVQSEPEQQPEPIKTQKNEPQPYS

SEQ ID NO: 4321 - protein, 56 aa, Mamastrovirus 1
YYDEDDDGWGMVGDDVEFDYTEVINFDQAKPTPAPRTTKPKPCPEPKIEAQPLDLS

SEQ ID NO: 4322 - protein, 56 aa, Mamastrovirus 1
DQGMKHLMTTPPVSSQLYFEMLTSLPQAMAEHFDQGDQAVVAHDSPGQALFSAEET

SEQ ID NO: 4323 - protein, 56 aa, Mamastrovirus 1
IVKLRTIIETAIKTQNYSALPEAVFELDKAAYEAGLEGFLQRVKSKNKAPEKQGPK

SEQ ID NO: 4324 - protein, 56 aa, Mamastrovirus 1
YDDDDDGWGLVGDDVEFDYTEVINFDQHRKKPTPAPRIFKPKLAPAPVTEVQPLDL

SEQ ID NO: 4325 - protein, 56 aa, Mamastrovirus 1
KAPSQVELLKEEIERLKAQLNSAAENPVTVVTQQPIVTLEQKSVSDSDVVDLVRTA

SEQ ID NO: 4326 - protein, 56 aa, Mamastrovirus 1
RDANGKVVATVPTRIKNVAFDFFQKLKQSGVRVGVNDFVVIKPGALCIIDTPEGKG

SEQ ID NO: 4327 - protein, 56 aa, Mamastrovirus 1
SNQRVRNIVNKQLELPGFTGPKPAIWQSATATLGTVGSNTRGTTEIEACILLNPVL

SEQ ID NO: 4328 - protein, 56 aa, Mamastrovirus 1
YDEDDDGWGMVGDDVEFDYTEVINFDQAKPIPAPRTTKQKICPEPEVESQPLDLSQ

SEQ ID NO: 4329 - protein, 56 aa, Enterovirus B; identical to SEQ ID NO: 4

SEQ ID NO: 4330 - protein, 56 aa, Enterovirus B
FIEQTALLQGDVVEAVENAVARVADTIGSGPSNSQAVPALTAVETGHTSQVTPSDT

SEQ ID NO: 4331 - protein, 56 aa, Enterovirus B
PFIQQEAKLQGEPGKAIESAISRVADTISSGPTNSEQVPALTAAETGHTSQVVPGD

SEQ ID NO: 4332 - protein, 56 aa, Enterovirus B
VTQTAFYQNDVQNAVERSIVRVADTLPSGPSNSESIPALTAAETGHTSQVVPSDTI

SEQ ID NO: 4333 - protein, 56 aa, Enterovirus B
IKQDSFYQGPPGEAVERAIARVADTISSGPVNSESIPALTAAETGHTSQVVPADTM

SEQ ID NO: 4334 - protein, 56 aa, Enterovirus B
PFISQQNFFQGPVEDAITAAIGRVADTVGTGPTNSEAIPALTAAETGHTSQVVPSD

SEQ ID NO: 4335 - protein, 56 aa, Enterovirus B
PFVEQEADLQGDSEHAVESAVSRVADTIMSGPSNSQQVPALTAVETGHTSQVVPSD

SEQ ID NO: 4336 - protein, 56 aa, Enterovirus B
IKQDTFYQGPTEESVERAMGRVADTIARGPSNSEQIPALTAVETGHTSQVDPSDTM

SEQ ID NO: 4337 - protein, 56 aa, Enterovirus B
FSVRMLKDTPFIEQSNELQGDVKEAVENAMGRVADTIRSGPTNSEAIPALTAVETG

SEQ ID NO: 4338 - protein, 56 aa, Enterovirus B
SSGPTNSEQVPALTAAETGHTSQVVPGDTIQTRHVKNYHSRSESTIENFLCRSACV

SEQ ID NO: 4339 - protein, 56 aa, Enterovirus B
TRFIKQTAFYQSPVEESIERSIGRVADTIGSGPSNSEAIPVLTAVETGHTSQVTPS

SEQ ID NO: 4340 - protein, 56 aa, Enterovirus B
ISQTAFYQSPVEGAIERAIARVADTMPSGPTNSEAVPALTAVETGHTSQVVPSDNM

SEQ ID NO: 4341 - protein, 56 aa, Enterovirus B
NSQQVPALTAVETGHTSQVVPSDTIQTRHVHNYHSRTESTLENFLGRSACVHIDSY

SEQ ID NO: 4342 - protein, 56 aa, Enterovirus B; identical to SEQ ID NO: 37

SEQ ID NO: 4343 - protein, 56 aa, Enterovirus B
SSKPTNSESIPALTAAETGHTSQVVPSDTMQTRHVKNYHSRSESSIENFLCRSACV

SEQ ID NO: 4344 - protein, 56 aa, Enterovirus B
FIEQTTELQSDVREAVEGAIGRVADTIRSGPSNSEAVPALTAAETGHTSQVVPSDT

SEQ ID NO: 4345 - protein, 56 aa, Enterovirus B
SGPSNSQAVPALTAVETGHTSQVTPSDTMQTRHVKNYHSRSESSIENFLSRSACVY

SEQ ID NO: 4346 - protein, 56 aa, Enterovirus B
SGPSNSEAVPALTAAETGHTSQVVPSDTMQTRHVKNYHSRSESTIENFLCRSACVR

SEQ ID NO: 4347 - protein, 56 aa, Enterovirus B
AMGRVADTIRSGPTNSEAIPALTAVETGHTSQVVPSDTMQTRHVKNYHSRTESSIE

SEQ ID NO: 4348 - protein, 56 aa, Enterovirus B
PFISQQNFFQGPVEDAITAAIGRVADTVGTGPTNSEAIPALTAAETGHTSQVVPGD

SEQ ID NO: 4349 - protein, 56 aa, Enterovirus B
ITQQALYQNDPEGALNKAVGRVADTIASGPVNTEQIPALTAVETGHTSQVVPSDTM

SEQ ID NO: 4350 - protein, 56 aa, Enterovirus B
IKQTNFYQGPTEESVERAMGRVADTIARGPSNSEQIPALTAVETGHTSQVDPSDTM

SEQ ID NO: 4351 - protein, 56 aa, Enterovirus B
PFIRQDNFYQGPVEESVERAMVRVADTVSSKPTNSESIPALTAAETGHTSQVVPSD

SEQ ID NO: 4352 - protein, 56 aa, Enterovirus B
ISQDNKLQGDVEEAIERARCTVADTMRTGPSNSASVPALTAVETGHTSQVTPSDTM

SEQ ID NO: 4353 - protein, 56 aa, Enterovirus B
GPRNSESIPALTAAETGHTSQVVPGDTMQTRHVKNYHSRTESSVENFLCRAACVYI

SEQ ID NO: 4354 - protein, 56 aa, Enterovirus B
GPSNSASVPALTAVETGHTSQVTPSDTMQTRHVKNYHSRSESTVENFLGRSACVYM

SEQ ID NO: 4355 - protein, 56 aa, Enterovirus B
MSGPSNSQQVPALTAVETGHTSQVVPSDTIQTRHVQNFHSRSESTIENFLSRSACV

SEQ ID NO: 4356 - protein, 56 aa, Enterovirus B
GTGPTNSEAIPALTAAETGHTSQVVPGDTMQTRHVKNYHSRSESTIENFLCRSACV

SEQ ID NO: 4357 - protein, 56 aa, Enterovirus B
LFQGPPIYREIKISVAPETPPPPAIADLLKSVDSEVVREYCKEKGWLVPEVNSTLQ

SEQ ID NO: 4358 - protein, 56 aa, Enterovirus B
PPIYREIRISVAPETPPPPAIADLLRSVDSEAVREYCKEKGWLVPEISSTLQIEKH

SEQ ID NO: 4359 - protein, 56 aa, Enterovirus B
IGSGPSNSEAIPVLTAVETGHTSQVTPSDTMQTRHVHNYHSRSESSVENFLARSAC

SEQ ID NO: 4360 - protein, 56 aa, Enterovirus B; identical to SEQ ID NO: 36

SEQ ID NO: 4361 - protein, 56 aa, Enterovirus B
GPVNTEQIPALTAVETGHTSQVVPSDTMQTRHVVNFHTRSESSLENFMGRAACAYI

SEQ ID NO: 4362 - protein, 56 aa, Enterovirus B
GTTLEALFQGPPIYREIKISVAPETPPPPAIADLLKSVDSEAVREYCKEKGWLVPE

SEQ ID NO: 4363 - protein, 56 aa, Enterovirus B
SVGATLEALFQGPPIYREIKISVAPETPPPPAIADLLKSVDSEAVREYCKEKGWLV

SEQ ID NO: 4364 - protein, 56 aa, Enterovirus B
FIEQAAELQNDVRQAVEGAIGRVADTIRSGPSNSEAVPALTAAETGHTSQVVPSDT

SEQ ID NO: 4365 - protein, 56 aa, Enterovirus B
FISQEGKLQGDEVKHEPTVANTTASGPSNSQQVPALTAVETGHTSQVVPSDTIQTR

SEQ ID NO: 4366 - protein, 56 aa, Enterovirus B
NINYYKDAASNSANRQEFAQDPGKFTEPVKDIMIKSMPALNSPSAEECGYSDRVRS

SEQ ID NO: 4367 - protein, 56 aa, Enterovirus B
TSATNSERVPNLTAVETGHTSQAVPGDTMQTRHVINNHVRSESTIENFLARSACVF

SEQ ID NO: 4368 - protein, 56 aa, Enterovirus B
GPTNSEAVPALTAVETGHTSQVVPSDNMQTRHVKNYHSRSETSVENFLCRSACVYF

SEQ ID NO: 4369 - protein, 56 aa, Enterovirus B
GPVNSESIPALTAAETGHTSQVVPADTMQTRHVKNYHSRSESTVENFLCRSACVYY

SEQ ID NO: 4370 - protein, 56 aa, Enterovirus B
DTQSDCKILCFVSACNDFSVRMLKDTPFIKQDSFYQGPPGEAVERAIARVADTISS

SEQ ID NO: 4371 - protein, 56 aa, Enterovirus B
GPSNSEQIPALTAVETGHTSQVDPSDTMQTRHVHNYHSRSESSIENFLCRSACVIY

SEQ ID NO: 4372 - protein, 56 aa, Enterovirus B
EYNHRHSVGATLEALFQGPPIYREIKISVAPETPPPPVIADLLKSVDSEDVREYCK

SEQ ID NO: 4373 - protein, 56 aa, Enterovirus B
NINYYKDSASNSANRQDFTQDPSKFTEPVKDVMIKTLPALNSPSAEECGFSDRVRS

SEQ ID NO: 4374 - protein, 56 aa, Enterovirus B
FIEQTSFYQGDVQNAVEGAMVRVADTVQTSATNSERVPNLTAVETGHTSQAVPGDT

SEQ ID NO: 4375 - protein, 56 aa, Enterovirus B
PIYREIKISIAPETPPPPAIADLLKSVDSEAVREYCKEKGWLVPEINSTLQIEKHV

SEQ ID NO: 4376 - protein, 56 aa, Enterovirus B
GIVTMGGEGVVGFADVRDLLWLEDDAMEQGVKDYVEQLGNAFGSGFTNQICEQVNL

SEQ ID NO: 4377 - protein, 56 aa, Enterovirus B
QGPPVYREIKISVAPETPPPPRIADLLKSVDSEAVREYCKEKGWLVPEVNSTLQIE

SEQ ID NO: 4378 - protein, 56 aa, Enterovirus B
GTGPTNSEAIPALTAAETGHTSQVVPSDTMQTRHVKNYHSRSESTIENFLCRSACV

SEQ ID NO: 4379 - protein, 56 aa, Enterovirus B
DMLVTEMFREYNHRHSVGATLEALFQGPPIYREIKISIAPETPPPPAIADLLKSVD

SEQ ID NO: 4380 - protein, 56 aa, Enterovirus B
HGVIGIVTMGGEGIVGFADVRDLLWLEDDAMEQGVKDYVEQLGNAFGTGFTNQICE

SEQ ID NO: 4381 - protein, 56 aa, Enterovirus B
NINYYKDAASNSANRQDFSQDPSKFTEPVKDIMIKSMPALNSPSAEECGYSDRVRS

SEQ ID NO: 4382 - protein, 56 aa, Enterovirus B
VGFADVRDLLWLEDDAMEQGVKDYVEQLGNAFGSGFTNQICEQVNLLKESLVGQDS

SEQ ID NO: 4383 - protein, 56 aa, Enterovirus B
VINTPNKTKLEPSVFHHIFEGNKEPAVLRNGDTRLKVNFEEAIFSKYIGNVNTHVD

SEQ ID NO: 4384 - protein, 56 aa, Enterovirus B
IGLVTMGGEGVVGFADVRDLLWLEDDAMEQGVKDYVEQLGNAFGSGFTNQICEQVN

SEQ ID NO: 4385 - protein, 56 aa, Enterovirus B
LPVINTPSKTKLEPSVFHQVFEGNKEPAVLRNGDPRLKANFEEAIFSKYIGNVNTH

SEQ ID NO: 4386 - protein, 56 aa, Enterovirus B
NINYYKDSASNSANRQDFTQDPSKFTEPVKDVMIKSLPALNSPSAEECGFSDRVRS

SEQ ID NO: 4387 - protein, 56 aa, Enterovirus B
IESSKEAGFPVINTPSKTKLEPSVFHQVFEGNKEPAVLRNGDPRLKANFEEALFSK

SEQ ID NO: 4388 - protein, 56 aa, Enterovirus B
NINYYKDAASNSANRQDFTQDPGKFTEPVKDIMAKTLPALNSPSAEECGYSDRVRS

SEQ ID NO: 4389 - protein, 56 aa, Enterovirus B
NINYYKDAASNSANRQDFTQDPGKFTEPVKDIMIKSLPALNSPTVEECGYSDRARS

SEQ ID NO: 4390 - protein, 56 aa, Enterovirus B
NINYYKDAASNSANRQDFTQDPSKFTEPVKDIMIKSLPALNSPTVEECGYSDRVRS

SEQ ID NO: 4391 - protein, 56 aa, Enterovirus B
GEGVVGFADVRDLLWLEDDAMEQGVKDYVEQLGNAFGSGFTNQICEQVNLLKESLV

SEQ ID NO: 4392 - protein, 56 aa, Enterovirus B
VTMGGEGVVGFADVRDLLWLEDDAMEQGVKDYVEQLGNAFGSGFTNQICEQVNLLK

SEQ ID NO: 4393 - protein, 56 aa, Enterovirus B
KLEPSVFHQVFEGNKEPAVLRNGDPRLKADFEEAIFSKYIGNVNTHVDEYMQEAVD

SEQ ID NO: 4394 - protein, 56 aa, Enterovirus B
GFADVRDLLWLEDDAMEQGVKDYVEQLGNAFGSGFTNQVCEQVNLLKESLVGQDSI

SEQ ID NO: 4395 - protein, 56 aa, Enterovirus B
NINYYKDAASNSANRQDFTQDPGKFTEPVKDIMIKSMPALNSPSAEECGYSDRVRS

SEQ ID NO: 4396 - protein, 56 aa, Enterovirus B
NINYYKDAASNSANRQDFTQDPGKFTEPMKDVMIKTLPALNSPTVEECGYSDRVRS

SEQ ID NO: 4397 - protein, 56 aa, Enterovirus B
LLWLEDDAMEQGVKDYVEQLGNAFGSGFTNQICEQVNLLKESLIGQDSVLEKSLKA

SEQ ID NO: 4398 - protein, 56 aa, Enterovirus B
GAPATCGVLCLASACNDFSVRMLRDTPFIEQKQLLQGDVEEAVNRAVARVADTLPT

SEQ ID NO: 4399 - protein, 56 aa, Enterovirus B
HSVGATLEALFQGPPLYREIKISVAPETPPPPAIADLLKSVDSEAVREYCKEKGWL

SEQ ID NO: 4400 - protein, 56 aa, Enterovirus B
QGPPVYREIKISVAPETPPPPAIADLLKSVDSEAVREYCKEKGWLVPEINSTLQIE

SEQ ID NO: 4401 - protein, 56 aa, Enterovirus B
PVINTPSKTKLEPSVFHQVFEGNKEPAVLRNGDPRLKVNFEEAIFSKYIGNVNTHV

SEQ ID NO: 4402 - protein, 56 aa, Enterovirus B
GATLEALFQGPPVIREIKISVAPETPPPPAIADLLKSVDSEAVREYCKEKGWLVPE

SEQ ID NO: 4403 - protein, 56 aa, Enterovirus B
GVVGFADVRDLLWLEDDAMEQGVKDYVEQLGNAFGSGFTNQICEQVNLLKESLVGQ

SEQ ID NO: 4404 - protein, 56 aa, Enterovirus B
VVGFADVRDLLWLEDDAMEQGVRDYVEQLGNAFGSGFTNQICEQVNLLKESLVGQD

SEQ ID NO: 4405 - protein, 56 aa, Enterovirus B
QGPPIYREIKISVAPDTPPPPAIADLLKSVDSEAVREYCREKGWLVPEINSTLQIE

SEQ ID NO: 4406 - protein, 56 aa, Enterovirus B
INTPSKTKLEPSVFHQVFEGNKEPAVLRNGDPRLRANFEEAIFSKYIGNVNTHVDE

SEQ ID NO: 4407 - protein, 56 aa, Enterovirus B
VVGFADVRDLLWLEDDAMEQGVKDYVEQLGNAFGSGFTNQICEQVNLLKESLVGQD

SEQ ID NO: 4408 - protein, 56 aa, Enterovirus B
NINYYKDAASNSANRQDFTQDPGKFTEPVKDIMIKSMPALNSPTAEECGYSDRVRS

SEQ ID NO: 4409 - protein, 56 aa, Enterovirus B
WLEDDAMEQGVKDYVEQLGNAFGSGFTNQICEQVNLLKESLVGQDSILEKSLKALV

SEQ ID NO: 4410 - protein, 56 aa, Enterovirus B
GLVTMGGEGVVGFADVRDLLWLEDDAMEQGVKDYVEQLGNAFGSGFTNQICEQVNL

SEQ ID NO: 4411 - protein, 56 aa, Enterovirus B
NINYYKDAASNSANRQEFSQDPGKFTEPVKDIMVKSLPALNSPSAEECGYSDRVRS

SEQ ID NO: 4412 - protein, 56 aa, Enterovirus B
FEGNKEPAVLRNGDPRLKANFEEALFSKYIGNVNTHVDEYMLEAVDHYAGQLATLD

SEQ ID NO: 4413 - protein, 56 aa, Enterovirus B
FREYNHRHSVGATLEALFQGPPVYREIKISVAPETPPPPAIADLLKSVDSEAVREY

SEQ ID NO: 4414 - protein, 56 aa, Enterovirus B
HQGFSAALLKHYFNDEQGEIEFIESSKDAGFPVINAPSRTKLEPSVFHQVFEGNKE

SEQ ID NO: 4415 - protein, 56 aa, Enterovirus B
TLEALFQGPPVYREIKISVAPEIPPPPAIADLLKSVDSEAVRDYCKEKGWLVPEVN

SEQ ID NO: 4416 - protein, 56 aa, Enterovirus B
GVVGFADIRDLLWLEDDAMEQGVKDYVEQLGNAFGSGFTNQICEQVNLLKESLVGQ

SEQ ID NO: 4417 - protein, 56 aa, Enterovirus B
VGFADVRDLLWLEDDAMEQGVKDYVEELGNSFGSGFTNQICEQVNLLKESLVGQDS

SEQ ID NO: 4418 - protein, 56 aa, Enterovirus B
FPIINTPSKTKLEPSVFHQVFEGDKEPAVLRNGDPRLKVNFEEAIFSKYIGNVNTH

SEQ ID NO: 4419 - protein, 56 aa, Enterovirus B
PETPTHCDILGFISACNDFSVRMLKDTPFISQEGKLQGDEVKHEPTVANTTASGPS

SEQ ID NO: 4420 - protein, 56 aa, Enterovirus B
NINYYKDAASNSANRQDFSQDPGKFTEPVKDLMIKSMPALNSPSAEECGFSDRVRS

SEQ ID NO: 4421 - protein, 56 aa, Enterovirus B
SSKDAGYPVINTPSRTKLEPSVFHQVFEGSKEPAVLRNGDPRLKANFEEAIFSKYI

SEQ ID NO: 4422 - protein, 56 aa, Enterovirus B
EQGVKDYVEQLGNAFGSGFTNQICEQVNLLKESLIGQDSILEKSLKALVKIISALV

SEQ ID NO: 4423 - protein, 56 aa, Enterovirus B
PIINTPSKTKLEPSVFHQVFEGNKEPAVLRNGDPRLKANFEEAIFSKYIGNVNTHV

SEQ ID NO: 4424 - protein, 56 aa, Enterovirus B
PPVYREIKISVTPETPPPPVIADLLKSVDRQAIREYCKEKGWLVPEIDSILQIEKH

SEQ ID NO: 4425 - protein, 56 aa, Enterovirus B
NINYYKDAASNSANRQDFTQDPSKFTEPVKDVMIKSLPALNSPTVEECGYSDRVRS

SEQ ID NO: 4426 - protein, 56 aa, Enterovirus B
LRNGDPRLKVNFEEAIFSKYIGNVNTHVDEYMQEAVDHYAGQLATLDISTEPMKLE

SEQ ID NO: 4427 - protein, 56 aa, Enterovirus B
MDKYGLNLPMVTYVKDELRSAEKVAKGKSRLIEASSLNDSVAMRQTFGNLYKTFHM

SEQ ID NO: 4428 - protein, 56 aa, Enterovirus B
AGFPVINAPSRTKLEPSVFHQVFEGNKEPAVLRNGDPRLKANFEEAIFSKYIGNVN

SEQ ID NO: 4429 - protein, 56 aa, Enterovirus B
FHQVFEGNKEPAVLRNGDPRLKANFEEAIFSKYIGNVNTHVDEYMLEAVDHYAGQL

SEQ ID NO: 4430 - protein, 56 aa, Enterovirus B
AMEQGVKDYVEQLGNAFGSGFTNQICEQVNLLKESLVGQDSILEKSLKALVKIISA

SEQ ID NO: 4431 - protein, 56 aa, Enterovirus B
PPDTPTDCIVLCFVSACNDFSVRMLKDTPFVEQEADLQGDSEHAVESAVSRVADTI

SEQ ID NO: 4432 - protein, 56 aa, Enterovirus B
PPDTPSQCYMLCLASACNDFSVRMLKDTPFIQQEAKLQGEPGKAIESAISRVADTI

SEQ ID NO: 4433 - protein, 56 aa, Enterovirus B
FPVINTPSKTKLEPSVFHQVFEGNKEPAVLRSGDPRLKANFEEAIFSKYIGNVNTH

SEQ ID NO: 4434 - protein, 56 aa, Enterovirus B
VKDLMIKSMPALNSPSAEECGFSDRVRSLTLGNSTITTQESANVVVGYGRWPDYLA

SEQ ID NO: 4435 - protein, 56 aa, Enterovirus B
VLRSGDPRLKANFEEAIFSKYIGNVNTHVDEYMLEAVDHYAGQLATLDISTEPMKL

SEQ ID NO: 4436 - protein, 56 aa, Enterovirus B
KKRDILSKKTKDLTKLKECMDKYGLNLPMVTYVKDELRSAEKVAKGKSRLIEASSL

SEQ ID NO: 4437 - protein, 56 aa, Enterovirus B
VLRNGDPRLKANFEEAIFSKYIGNVNTHVDEYMLEAVDHYAGQLATLDISTEPMKL

SEQ ID NO: 4438 - protein, 56 aa, Enterovirus B
VLRNGDPRLKVNFEEAIFSKYIGNVNTHVDEYMMEAVDHYAGQLATLDISTEPMKL

SEQ ID NO: 4439 - protein, 56 aa, Enterovirus B
PADVQSTCDILCFVSACNDFSVRMLKDTPFIRQDNFYQGPVEESVERAMVRVADTV

SEQ ID NO: 4440 - protein, 56 aa, Enterovirus B
HQVFEGNKEPAVLRSGDPRLKANFEEAIFSKYIGNVNTHVDEYMMEAVDHYAGQLA

SEQ ID NO: 4441 - protein, 56 aa, Enterovirus B
QGVKDYVEQLGNAFGSGFTNQICEQVNLLKESLVGQDSILEKSLKALVKIISALVI

SEQ ID NO: 4442 - protein, 56 aa, Enterovirus B
KRDILSKKSKDLTKLKECMDKYGLNLPMVTYVKDELRSAEKVAKGKSRLIEASSLN

SEQ ID NO: 4443 - protein, 56 aa, Enterovirus B
AALLKHYFNDEQGEIEFIESSKEAGFPVINTPSKTKLEPSVFHQVFEGNKEPAVLR

SEQ ID NO: 4444 - protein, 56 aa, Enterovirus B
IESSKDAGFPVINTPSKTKLEPSVFHQVFEGNKEPAVLRNGDPRLKVNFEEAIFSK

SEQ ID NO: 4445 - protein, 56 aa, Enterovirus B
VAPETPPPPVIADLLKSVDSEDVREYCKEKGWLIPEVNSTLQIEKYVSRAFICLQA

SEQ ID NO: 4446 - protein, 56 aa, Enterovirus B
FEGNKEPAVLRNGDPRLKVNFEEAIFSKYIGNINTHVDEYMLEAVDHYAGQLATLD

SEQ ID NO: 4447 - protein, 56 aa, Enterovirus B
EPSVFHQVFEGVKEPAVLRNGDPRLKANFEEAIFSKYIGNVNTHVDEYMLEAVDHY

SEQ ID NO: 4448 - protein, 56 aa, Enterovirus B
RLKQLPLLESQIATIEQSAPSQSDQEQLFSNVQYFAHYCRKYAPLYAAEAKRVFSL

SEQ ID NO: 4449 - protein, 56 aa, Enterovirus B
NINYYKDAASNSANRQDFTQDPSKFTEPVKDVMIKTLPALNSPSAEECGYSDRVRS

SEQ ID NO: 4450 - protein, 56 aa, Enterovirus B
VKDIMIKSMPALNSPSAEECGYSDRVRSITLGNSTITTQECANVVVGYGTWPRYLS

SEQ ID NO: 4451 - protein, 56 aa, Enterovirus B
KKRDILSKKTRDLTKLKECMDKYGLNLPMVTYVKDELRSAEKVAKGKSRLIEASSL

SEQ ID NO: 4452 - protein, 56 aa, Enterovirus B
LRNGDPRLKANFEEAIFSKYIGNVNTHVDEYMLEAVDHYAGQLATLDINTEPMKLE

SEQ ID NO: 4453 - protein, 56 aa, Enterovirus B
MEQGVKDYVEQLGNAFGSGFTNQICEQVNLLKESLVGQDSILEKSLKALVKIISAL

SEQ ID NO: 4454 - protein, 56 aa, Enterovirus B
KECMDKYGLNLPMVTYVKDELRPAEKVAKGKSRLIEASSLNDSVAMRQTFGNLYKT

SEQ ID NO: 4455 - protein, 56 aa, Enterovirus B
LPMVTYVKDELRSAEKVAKGKSRLIEASSLNDSVAMRQTFGNLYKAFHLNPGIVTG

SEQ ID NO: 4456 - protein, 56 aa, Enterovirus B
VFEGNKEPAVLRNGDPRLKANFEEAIFSKYIGNVNTHVDEYMMEAVDHYAGQLATL

SEQ ID NO: 4457 - protein, 56 aa, Enterovirus B
FSAALLRHYFNEEQGEIEFIESSKDAGFPVINTPSKTKLEPSVFHQVFEGNKEPAV

SEQ ID NO: 4458 - protein, 56 aa, Enterovirus B
KLEDAVYGTEGLEALDLTTSAGYPYVALGIKKRDILSKKTKDLTKLKECMDKYGLN

SEQ ID NO: 4459 - protein, 56 aa, Enterovirus B
MGAQVSTQKTGAHETGLNASGNSIIHYTNINYYKDAASNSANRQDFTQDPGKFTEP

SEQ ID NO: 4460 - protein, 56 aa, Enterovirus B
TYVKDELRSAEKVAKGKSRLIEASSLNDSVAMRQTFGNLYKTFHLNPGIVTGSAVG

SEQ ID NO: 4461 - protein, 56 aa, Enterovirus B
RDILSKKTKDLTKLKECMDKYGLNLPMVTYVKDELRSAEKVAKGKSRLIEASSLND

SEQ ID NO: 4462 - protein, 56 aa, Enterovirus B
YVKDELRSAEKVAKGKSRLIEASSLNDSVAMRQTFGNLYKTFHLNPGIVTGSAVGC

SEQ ID NO: 4463 - protein, 56 aa, Enterovirus B
EIEFIESSKDAGFPIINTPSKTKLEPSVFHQVFEGNKEPAVLRNGDPRLKANFEEA

SEQ ID NO: 4464 - protein, 56 aa, Enterovirus B
DAMEQGVKDYVEQLGNAFGTGFTNQICEQVNLLKESLVGQDSILEKSLKALVKIIS

SEQ ID NO: 4465 - protein, 56 aa, Enterovirus B
GSKEPAVLRNGDPRLKANFEEAIFSKYIGNVNTHVDEYMLEAIDHYAGQLATLDIS

SEQ ID NO: 4466 - protein, 56 aa, Enterovirus B
SEAVREYCKEKGWLVPEINSTLQIEKHVSRAFICLQALTTFVSVAGIIYIIYKLFA

SEQ ID NO: 4467 - protein, 56 aa, Enterovirus B
KKRDILSKKTKDLTKLKECMDKYGLNLPMVTYVKDELRSIEKVAKGKSRLIEASSL

SEQ ID NO: 4468 - protein, 56 aa, Enterovirus B
FIESSKEAGFPVINTPSKTKLEPSVFHHVFEGNKEPAVLRNGDPRLKANFEEAIFS

SEQ ID NO: 4469 - protein, 56 aa, Enterovirus B
HYAGQLATLDISTEPMKLEDAVYGTEGLEALDLTTSAGYPYVALGIKKRDILSKRT

SEQ ID NO: 4470 - protein, 56 aa, Enterovirus B
DKYGLNLPMVTYVKDELRSSEKVAKGKSRLIEASSLNDSVAMRQTFGNLYKTFHLN

SEQ ID NO: 4471 - protein, 56 aa, Enterovirus B
KDLTKLKECMDKYGLNLPMVTYVKDELRSAEKSPRGKSRLIEASSLNDSVAMRQTF

SEQ ID NO: 4472 - protein, 56 aa, Enterovirus B
PAIADLLKSVDSEAVREYCKEKGWLVPEVNSTLQIEKHVSRAFICLQALTTFVSVA

SEQ ID NO: 4473 - protein, 56 aa, Enterovirus B
EKVAKGKSRLIEASSLNDSVAMRQTFGNLYKTFHLNPGIVTGSAVGCDPDLFWSKI

SEQ ID NO: 4474 - protein, 56 aa, Enterovirus B
VKDIMIKSMPALNSPSAEECGYSDRVRSITLGNSTITTQESANVVVAYGRWPKYLE

SEQ ID NO: 4475 - protein, 56 aa, Enterovirus B
ECMDKYGLNLPMVTYVKDELRSAEKVAKGKSRLIEASSLNDSVAMRQTFGNLYKTF

SEQ ID NO: 4476 - protein, 56 aa, Enterovirus B
VTYVKDELRSAEKVAKGKSRLIEASSLNDSVAMRQTFGNLYKTFHLNPGIVTGSAV

SEQ ID NO: 4477 - protein, 56 aa, Enterovirus B
CMDKYGLNLPMVTYVKDELRSADKVAKGKSRLIEASSLNDSVAMRQTFGNLYRTFH

SEQ ID NO: 4478 - protein, 56 aa, Enterovirus B
KRDILSKKTKDLTKLKECMDKYGLNLPMVTYVKDELRSAEKVAKGKSRLIEASSLN

SEQ ID NO: 4479 - protein, 56 aa, Enterovirus B
EAQKSCYIMCFVSACNDFSVRMLRDTQFIKQTNFYQGPTEESVERAMGRVADTIAR

SEQ ID NO: 4480 - protein, 56 aa, Enterovirus B
AGYPYVALGIKKRDILSRRTRDLTKLKECMDKYGLNLPMVTYVKDELRSADKVAKG

SEQ ID NO: 4481 - protein, 56 aa, Enterovirus B
VDSEAVREYCKEKGWLVPEINSTLQIEKHVSRAFICLQALTTFVSVAGIIYIIYKL

SEQ ID NO: 4482 - protein, 56 aa, Enterovirus B
EAQKSCYIMCFVSACNDFSVRMLRDTQFIKQDTFYQGPTEESVERAMGRVADTIAR

SEQ ID NO: 4483 - protein, 56 aa, Enterovirus B
FNEEQGEIEFIESSKDAGFPVINTPSKTKLEPSVFHQVFEGNKEPAVLRNGDPRLK

SEQ ID NO: 4484 - protein, 56 aa, Enterovirus B
IEFIESSKDAGFPIINTPSKTKLEPSVFHQVFEGNKEPAVLRSGDPRLKANFEEAI

SEQ ID NO: 4485 - protein, 56 aa, Enterovirus B
DIPTTSTILCFVSACNDFSVRLLRDTPFITQQALYQNDPEGALNKAVGRVADTIAS

SEQ ID NO: 4486 - protein, 56 aa, Enterovirus B
VKDIMIKSMPALNSPTAEECGYSDRVRSITLGNSTITTQECANVVVGYGTWPDYLH

SEQ ID NO: 4487 - protein, 56 aa, Enterovirus B
GFSAALLKHYFNDEQGEIEFIESSKEAGLPVINTPSKTKLEPSVFHQVFEGNKEPA

SEQ ID NO: 4488 - protein, 56 aa, Enterovirus B
GPPVYREIKISVAPETPPPPAIADLLKSVDSEAVREYCKEKGWLVPEISSTLQIEK

SEQ ID NO: 4489 - protein, 56 aa, Enterovirus B
PAVLRNGDPRLKANFEEAIFSKYIGNVNTRVDEYMLEAVDHYAGQLATLDISTEPM

SEQ ID NO: 4490 - protein, 56 aa, Enterovirus B
CTTGVYFCASKNKHYPVSFEGPGLVEVQESEYYPKRYQSHVLLAAGFSEPGDCGGI

SEQ ID NO: 4491 - protein, 56 aa, Enterovirus B
NINYYKDSASNSLNRQDFTQDPSRFTEPVQDVLIKTLPALNSPTVEECGYSDRVRS

SEQ ID NO: 4492 - protein, 56 aa, Enterovirus B
AGTPTSCSIMCFVSACNDFSVRLLKDTPFIEQTALLQGDVVEAVENAVARVADTIG

SEQ ID NO: 4493 - protein, 56 aa, Enterovirus B
GRSLAEKLNSSVYSLPPDPDHFDGYKQQAVVIMDDLCQNPDGKDVSLFCQMVSSVD

SEQ ID NO: 4494 - protein, 56 aa, Enterovirus B
DILSKKTRDLTKLKECMDKYGLNLPMVTYVKDELRSAEKVAKGKSRLIEASSLNDS

SEQ ID NO: 4495 - protein, 56 aa, Enterovirus B
NGDPRLRANFEEAIFSKYIGNVNTHVDEYMLEAVDHYAGQLATLDISTEPMRLEDA

SEQ ID NO: 4496 - protein, 56 aa, Enterovirus B
ASNQPKCYMMCMVSACNDFSVRMLRDTKFIEQTSFYQGDVQNAVEGAMVRVADTVQ

SEQ ID NO: 4497 - protein, 56 aa, Enterovirus B
LTKLKECMDKYGLNLPMITYVKDQLRSAEKVAKGKSRLIEASSLNDSVAMRQTFGN

SEQ ID NO: 4498 - protein, 56 aa, Enterovirus B
FEEAIFSKYIGNVNTHVDEYMLEAVDHYAGQLATLDISTEPMKLEDAVYGTEGLEA

SEQ ID NO: 4499 - protein, 56 aa, Enterovirus B
DEQGEIEFIESSKDAGFPIINTPSKTKLEPSVFHQVFEGVKEPAVLRNGDPRLKAN

SEQ ID NO: 4500 - protein, 56 aa, Enterovirus B
NINYYKDAASNSSNRQTLEQDPSKFTEPVLDVMVKSLPALNSPSAEECGYSDRVRS

SEQ ID NO: 4501 - protein, 56 aa, Enterovirus B
VINTPSRTKLEPSVFHHVFEGNKEPAVLRNGDPRLKVNFEEAIFFKYIGNVNTHVD

SEQ ID NO: 4502 - protein, 56 aa, Enterovirus B
ADFEEAIFSKYIGNVNTHVDEYMQEAVDHYAGQLATLDISTEPMKLEDAVYGTEGL

SEQ ID NO: 4503 - protein, 56 aa, Enterovirus B
SAGLLKHYFNDEQGEIEFIESSKDAGFPVINTPSRTKLEPSVFHHVFEGNKEPAVL

SEQ ID NO: 4504 - protein, 56 aa, Enterovirus B
MGAQVSTQKTGAHETLLEAAQGATINYTNINYYKDAASNSANRQDFSQDPSKFTEP

SEQ ID NO: 4505 - protein, 56 aa, Enterovirus B
SASLLRHYFNDEQGEIEFIESSKEAGFPVINTPNKTKLEPSVFHHIFEGNKEPAVL

SEQ ID NO: 4506 - protein, 56 aa, Enterovirus B
VKEKHEFLNRLKQLPLLESQIATIEQSAPSQSDQEQLFSNVQYFAHYCRKYAPLYA

SEQ ID NO: 4507 - protein, 56 aa, Enterovirus B
ISTEPMKLEDAVYGTEGLEALDLTTSAGYPYVAIGIKKRDILSKKTKDLTKLKECM

SEQ ID NO: 4508 - protein, 56 aa, Enterovirus B
TWTNVTFLKRYFRADEQYPFLVHPVMPMKDIHESIRWTKDPKNTQDHVRSLCLLAW

SEQ ID NO: 4509 - protein, 56 aa, Enterovirus B
GIKKRDILSKKTKDLTKLKECMDKYGLNLPMVTYVKDELRSAEKVAKGKSRLIEAS

SEQ ID NO: 4510 - protein, 56 aa, Enterovirus B
PETPSDCVVLCFVSACNDFSVRMLKDTPFIEQTTELQSDVREAVEGAIGRVADTIR

SEQ ID NO: 4511 - protein, 56 aa, Enterovirus B
VKDIMIKSMPALNSPSAEECGYSDRVRSITLGNSTITTQECANVVVGYGTWPTYLK

SEQ ID NO: 4512 - protein, 56 aa, Enterovirus B
EDAVYGTEGLEALDLTTSAGYPYVALGIKKRDILSKKTRDLTKLKECMDKYGLNLP

SEQ ID NO: 4513 - protein, 56 aa, Enterovirus B
VKDIMIKSMPALNSPSAEECGYSDRVRSITLGNSTITTQECANVVVGYGVWPEYLK

SEQ ID NO: 4514 - protein, 56 aa, Enterovirus B
SRLIEASSLNDSVAMRQTFGNLYKTFHMNPGIVTGSAVGCDPDLFWSKIPVMLDGH

SEQ ID NO: 4515 - protein, 56 aa, Norwalk virus; identical to SEQ ID NO: 11

SEQ ID NO: 4516 - protein, 56 aa, Norwalk virus
MKMASNDASAAAVANSNNDTAKSSSDGVLSSMAITFKRALGARPKQPPPREILQRP

SEQ ID NO: 4517 - protein, 56 aa, Norwalk virus
LSSMAVTFKRALGGRAKQPPPRETPQRPPRPPTPELVKKIPPPPPNGEDELVVSYS

SEQ ID NO: 4518 - protein, 56 aa, Norwalk virus
MKMASNDASAAAVVNSNNDTAKSSSDGVLSSMAVTFKRALGGRAKQPPPRETPQRP

SEQ ID NO: 4519 - protein, 56 aa, Norwalk virus
LSDEEYDEYKRIREERNGKYSIEEYLQDRDKYYEEVAIARATEEDFCEEEEAKIRQ

SEQ ID NO: 4520 - protein, 56 aa, Norwalk virus
PRPPTPELVKKIPPPPPNGEDELVVSYSVKDGVSGLPELSTVRQPDEANTAFSVPP

SEQ ID NO: 4521 - protein, 56 aa, Norwalk virus
ITTNLANPAPLDYVNFEACSRRIDFLVYADAPEVEKAKRDFPGQPDMWKNAFSPDF

SEQ ID NO: 4522 - protein, 56 aa, Norwalk virus
ITTNLANPAPLDYVNFEACSRRIDFLVYAEAPEVEKAKRDFPGQPDMWKNAFSPDF

SEQ ID NO: 4523 - protein, 56 aa, Norwalk virus
SDDIKTEGKKGKNKTGRGKKHTAFSSKGLSDEEYDEYKRIREERNGKYSIEEYLQD

SEQ ID NO: 4524 - protein, 56 aa, Norwalk virus
FSRRGLNDEEYEEYKKIREEKGGNYSIQEYLEDRQRYEEELAEVQAGGDGGIGETE

SEQ ID NO: 4525 - protein, 56 aa, Norwalk virus
ADAPEVEKAKRDFPGQPDMWKNAFSPDFSHIKLTLAPQGGFDKNGNTPHGKGVMKT

SEQ ID NO: 4526 - protein, 56 aa, Norwalk virus
SRRGLSDEEYEEYKKIREEKNGNYSIQEYLEDRQRYEEELAEVQAGGDGGIGETEM

SEQ ID NO: 4527 - protein, 56 aa, Norwalk virus
RIFRPTRKQRKEERASLGLVTGSEIRKRNPDDFKPKGKLWADDDRSVDYNERLSFE

SEQ ID NO: 4528 - protein, 56 aa, Norwalk virus
TKSGNTVVCAVQAGEGETALEGGDKGHYAGHEIVRYGSGPALSTKTKFWRSSPEPL

SEQ ID NO: 4529 - protein, 56 aa, Norwalk virus
SRRGLSDEEYEEYKKIREEKNGNYSIQEYLEDRQRYEEEMAEVQAGGDGGIGETEM

SEQ ID NO: 4530 - protein, 56 aa, Norwalk virus
AEAPEVEKAKRDFPGQPDMWKNAFSPDFSHIKLALAPQGGFDKNGNTPHGKGVMKT

SEQ ID NO: 4531 - protein, 56 aa, Norwalk virus
SHIKLALAPQGGFDKNGNTPHGKGVMKTLTTGSLIARASGLLHERLDEYELQGPAL

SEQ ID NO: 4532 - protein, 56 aa, Norwalk virus
KLDPEKLTAKLKEYGLKPTRPDKTEGPLTISEDLNGLTFLRRTVTRDPAGWFGKLE

SEQ ID NO: 4533 - protein, 56 aa, Norwalk virus
PYHRRKNDDWNGTTFVRELGEQAAHANNMYEQAKSMKPMYTGALKDELVKPEKVYQ

SEQ ID NO: 4534 - protein, 56 aa, Norwalk virus
SHIKLTLAPQGGFDKNGNTPHGKGVMKTLTTGSLIARASGLLHERLDEYELQGPTL

SEQ ID NO: 4535 - protein, 56 aa, Norwalk virus
WDAYKGERVVLWDDYGMSNPIHDALRLQELADTCPLTLNCDRIENKGKVFDSDAII

SEQ ID NO: 4536 - protein, 56 aa, Norwalk virus
MTSLLKDKDSLATYMRTLDLEEEKARKLSTKSASPDIVGTINALLARIAAARSLVH

SEQ ID NO: 4537 - protein, 56 aa, Norwalk virus
RIFRPTRKQRKEERASLGLVTGSEIRKRNPDDFKPKGKLWADDDRSVDYNEKLDFE

SEQ ID NO: 4538 - protein, 56 aa, Norwalk virus
NPDDFKPKGKLWADDDRSVDYNEKLDFEAPPSIWSRIVNFGSGWGFWVSPSLFITS

SEQ ID NO: 4539 - protein, 56 aa, Norwalk virus
PGVYEPAYLGGRDPRVTVGPSLQQVLRDQLKPFAEPRGRMPEPGLLEAAVETVTSS

SEQ ID NO: 4540 - protein, 56 aa, Norwalk virus
VKDGVSGLPELSTVRQPDEANTAFSVPPLNQRENRDAKEPLTGTILEMWDGEIYHY

SEQ ID NO: 4541 - protein, 56 aa, Norwalk virus
VEMSNKLLAKNLNTRYSLLQAGGLSPSDAARAVAGAPVTRLVDWGGVRVAAPQSSA

SEQ ID NO: 4542 - protein, 56 aa, Norwalk virus
RDKYYEEVAIARATEEDFCEEEEAKIRQRIFRPTRKQRKEERASLGLVTGSEIRKR

SEQ ID NO: 4543 - protein, 56 aa, Norwalk virus
YPHHKRKNDDWNGTTFVGELGEQAAHANNMYENAKHMKPIYTAALKDELVKPEKIY

SEQ ID NO: 4544 - protein, 56 aa, Norwalk virus
VQASNALLAKNLNTRYSMLIAGGLSSADASRAVAGAPVTRLIDWNGTRVAAPRSSA

SEQ ID NO: 4545 - protein, 56 aa, Norwalk virus
VEASNQLLAKNLATRYSLLRAGGLTSADAARSVAGAPVTRIVDWNGVRVSAPESSA

SEQ ID NO: 4546 - protein, 56 aa, Human adenovirus A
EAMDELQPTMQLMVPKRQKLEDVLEHMKVDPSVQPDVKVRPIKKVAPGLGVQTVDI

SEQ ID NO: 4547 - protein, 56 aa, Human adenovirus A
DELQPTMQLMVPKKQKLEDVLEHIEVDPSIQPDVKIRPIKKVAPGLGVQTVDIQIP

SEQ ID NO: 4548 - protein, 56 aa, Human adenovirus A
REAMNDLQPTMQLMVPKRQKLEDVLEYMKVDPNIQPDVKIRPIKKVAPGLGVQTVD

SEQ ID NO: 4549 - protein, 49 aa, Human adenovirus A
PTGRARRRAAAAAASAIANLAAPRRGNVYWVRDSVTGMRVPVRTRPPHP

SEQ ID NO: 4550 - protein, 56 aa, Human adenovirus A
VDPSVQPDVKVRPIKKVAPGLGVQTVDIQIPVQTALGETMEIQTSPIKTTVNASVQ

SEQ ID NO: 4551 - protein, 56 aa, Human adenovirus A
SIQPDVKIRPIKKVAPGLGVQTVDIQIPVKTAFGEPMETQTSPMETQTSPIKTVAD

SEQ ID NO: 4552 - protein, 45 aa, Human adenovirus A
INRRVVAHASQLRAQHLPLPERQADIRLPQAPAEAEVPVPARRRF

SEQ ID NO: 4553 - protein, 56 aa, Human adenovirus A
PYVPPRYLGPTEGRNSIRYSELSPLYDTTRVYLVDNKSSDIASLNYQNDHSNFLTT

SEQ ID NO: 4554 - protein, 56 aa, Human adenovirus A
TGESEYLNDPILFPVRDKNFPNNGIESLVDKMSRWKTYAQERREWEERQPRPVRPP

SEQ ID NO: 4555 - protein, 56 aa, Human adenovirus A
MQRDRRYRYRLAPYNKYQLPPCEEQSKATLSTSENSLWPECNSLTLHNVSEVRGIP

SEQ ID NO: 4556 - protein, 56 aa, Human adenovirus A
LVEMDVTSENGQRALKENPSKAKVVQNRWGRNVVQIKNDDARCCFHDVGCGSNSFS

SEQ ID NO: 4557 - protein, 56 aa, Human adenovirus A
KVDPNIQPDVKIRPIKKVAPGLGVQTVDIQIPVQAAQSKTMETQTSPIKTAVDSGM

SEQ ID NO: 4558 - protein, 56 aa, Human adenovirus A
NPTPSLKAVTLQQVLPVLATSEEKRGIKREAMNDLQPTMQLMVPKRQKLEDVLEYM

SEQ ID NO: 4559 - protein, 56 aa, Human adenovirus A
MQRPAIIAERAPNLDPAVLAAMQSQPSGVTASDDWTAAMDRIMALTARSPDAFRQQ

SEQ ID NO: 4560 - protein, 56 aa, Human adenovirus A
TSDVPFVTPPFTSSNGLQEKPPGVLALNYKDPIVTENGTLTLKLGDGIKLNAQGQL

SEQ ID NO: 4561 - protein, 36 aa, Human adenovirus A
PPRLVIPEFKWHQRLQYRNISLPTNHGDCREEPFDF

SEQ ID NO: 4562 - protein, 56 aa, Human adenovirus A
YKDPIVTENGTLTLKLGDGIKLNAQGQLTASNTAKVLEPLTNTTQGIKLSWSAPLA

SEQ ID NO: 4563 - protein, 56 aa, Human adenovirus A
MRRAVELQTVAFPETPPPSYETVMAAAPPYVPPRYLGPTEGRNSIRYSELSPLYDT

SEQ ID NO: 4564 - protein, 56 aa, Human adenovirus A
TTIVPFITPPFTTSNGLQEKPPGVLALSYKDPIVTENGTLTLKLGDGIKLNAQGQL

SEQ ID NO: 4565 - protein, 56 aa, Human adenovirus A
INLQANLWRSFLYSNVGLYLPDDLKYTPGNIKLPENKNTYEYMNGRVTVPGLVDTY

SEQ ID NO: 4566 - protein, 56 aa, Human adenovirus A
EVMVEEKLPPLETVPGSVPTKGEKRPRPDAEETLVTHTTEPPSYEEAIKQGAALSP

SEQ ID NO: 4567 - protein, 56 aa, Human adenovirus A
SQHPVRVRGHYRAPWGAHTRGRTGRTTVDDVIDSVVADARKYRRPATSAGSTVDAV

SEQ ID NO: 4568 - protein, 30 aa, Human adenovirus A
LYSNVGLYLPDDLKYTPGNIKLPDNKNTYE

SEQ ID NO: 4569 - protein, 56 aa, Human adenovirus A
YLAEAQGEDTRFSTSRLSLKRTLASAQPGAHPFTVTETTLTRTLRPWKDKTLVHLD

SEQ ID NO: 4570 - protein, 56 aa, Human adenovirus A
KAWNSQTGQMLRDKLKDQNFQQKVVDGLASGINGVVDIANQAVQKKIANRLEPRPD

SEQ ID NO: 4571 - protein, 56 aa, Human adenovirus A
MSPKTAKQAIAQQRSKKQLQQQEIWEEDSWDSQAQEDQDLEEWEEESLDEDPEEDG

SEQ ID NO: 4572 - protein, 36 aa, Human adenovirus A
SLTRSCLYLKSEDQLQRTLEDAEALFNKYCALSLKD

SEQ ID NO: 4573 - protein, 56 aa, Human adenovirus A
MEINLQANLWRSFLYSNVGLYLPDDLKYTPGNIKLPDNKNTYEYMNGRVTAPGLVD

SEQ ID NO: 4574 - protein, 56 aa, Human adenovirus A
MSKDIPTPYMWSFQPQMGLAAGAAQDYSTKMNWLSAGPHMISQVNGIRARRNQMLL

SEQ ID NO: 4575 - protein, 56 aa, Human adenovirus A
MRTEMTPLVLSYQEADDILEHLVDNFFNEVPSDDDLYVPSLYELYDLDVESAGEDN

SEQ ID NO: 4576 - protein, 56 aa, Human adenovirus A
MKRSRTQYAEEPEENDDFNPVYPFDPYDTAHVPFVTPPFTSSNAFQEKPPGVLSLN

SEQ ID NO: 4577 - protein, 56 aa, Human adenovirus A
EVPSDDDFYVPSLHELYDIDVESAGEDSNEQAVNDFFPESFILAAAEGVILPEPPV

SEQ ID NO: 4578 - protein, 56 aa, Human adenovirus A
DSVELSFRFKTTGPVVFTQRRQIQDINRRVVAHASQLRAQHLPLPERQADIPLPPL

SEQ ID NO: 4579 - protein, 56 aa, Human adenovirus A
SWDSQAQEDQDLEEWEEESLDEDPEEDGSKDGATAAKPSLSTEPSPVKHTVNKSQK

SEQ ID NO: 4580 - protein, 56 aa, Human adenovirus A; identical to SEQ ID NO: 4571

SEQ ID NO: 4581 - protein, 56 aa, Human adenovirus A
HCGSTSKGKIRAKGHATEALSYDLMLKCYLAEAQGEDTRFSTSRLSLKRTLASAQP

SEQ ID NO: 4582 - protein, 56 aa, Human adenovirus A
MIEADLEVDGRITEQRLLTNRARQRQQEQKHKELLDLQTVHQCKKGLFCLVKQATL

SEQ ID NO: 4583 - protein, 56 aa, Human adenovirus A
MSKDIPTPYMWSFQPQMGLAAGAAQDYSSKMNWLSAGPHMISRVNGVRARRNQILL

SEQ ID NO: 4584 - protein, 56 aa, Human adenovirus A
PQANRFSAILEAVVPSRTNPTHEKVLTIVNALLDSKAIRKDEAGLIYNALLERVAR

SEQ ID NO: 4585 - protein, 56 aa, Human adenovirus A
PTPSLKAVTLQQVLPVLGPSEEKRGIKREAMDELQPTMQLMVPKRQKLEDVLEHMK

SEQ ID NO: 4586 - protein, 56 aa, Human adenovirus A
FASSANDNQNDPTVVMYSEDVNLEAPDTHIVYKPAVTADTISSELLHGQQAAPNRP

SEQ ID NO: 4587 - protein, 53 aa, Human adenovirus A
QIQDINRRVVARASQLRAQHLPLPERQADIPLPQLYAGPEPPLPPGARPRRRF

SEQ ID NO: 4588 - protein, 56 aa, Cowpox virus
DFDNNVYTVKDKNYTNAVIEYPVVCNFRRYSESDSDSDVDDRAELHKRNNDSDSDD

SEQ ID NO: 4589 - protein, 56 aa, Cowpox virus
KNATVDNNTINNNITVNNTKVDDETSDNNTLHGNIGFLEINNCYNVSVSDASFRIT

SEQ ID NO: 4590 - protein, 56 aa, Cowpox virus
LYDEVTNMLVCSNMDPDLIDRYYAKICLDFDNNVYTVKDKNYTNAVIEYPVVCNFR

SEQ ID NO: 4591 - protein, 56 aa, Cowpox virus
TRDQQDNNNKGFSKFVSPRRCRRSTSGVVCGMIQSRPNDDTYSLLQRPKIEPEYAE

SEQ ID NO: 4592 - protein, 56 aa, Cowpox virus
IDYDDNKDDDKDDDKDDNKDDDKDDNKDDDKDDKDDNKDDDSDSDSDSDSDSDSDD

SEQ ID NO: 4593 - protein, 56 aa, Cowpox virus
SPFQNVKSRASLLAEKIMPRVPTTATEEQLYATVNKQTKLPAGVKSTPFTEALVST

SEQ ID NO: 4594 - protein, 56 aa, Cowpox virus
EVVAEYKQKYGGASRGRTSSSSSSDFEDIDEVVAEYRQKYGNAMTKGRGSPKPDPL

SEQ ID NO: 4595 - protein, 56 aa, Cowpox virus
IDEVVAEYRQKYGNAMTKGRGSPKPDPLYSTVKKTPKSIASGVDIVSKQSDYSLLP

SEQ ID NO: 4596 - protein, 56 aa, Cowpox virus
IHSDKRISFPMYDDLIEQCHLSMKYKSKLVDKALNKLETTIDGQTRLSYLPPEIMR

SEQ ID NO: 4597 - protein, 56 aa, Cowpox virus
DDKDDKDDNKDDDSDSDSDSDSDSDSDDSDSDDSDSDDSDSDDSDSDSDDEDEDSR

SEQ ID NO: 4598 - protein, 56 aa, Cowpox virus
NLLAQIGGDAAVKGGNNNLNSQTDVTAGACDTKSKSSKCITCKPKSKSSSSSTSTS

SEQ ID NO: 4599 - protein, 56 aa, Cowpox virus
FYDETQDQSTQLVGYDIKLKTNEDDFVDEFYGYDRSVGVHDYIDESINKVVYGRES

SEQ ID NO: 4600 - protein, 56 aa, Cowpox virus
DVSTQTWEKKSELDRYMEMYPRHRYSKHSVFKGFSDKVRKNDLDMNVVKELLSNGA

SEQ ID NO: 4601 - protein, 56 aa, Cowpox virus
NHAKYIDEINSKKTRISDLERQLAACKSNGGSNGDMDQYKREIESLKRELAECRRG

SEQ ID NO: 4602 - protein, 56 aa, Cowpox virus
SPFQNVKSRASLLAEKIMPRVPTTATEEQLYATINRQAKLPAGVKSTPFTEALVST

SEQ ID NO: 4603 - protein, 56 aa, Cowpox virus
SIDSVIPRGTTHFQVGASGASGGVVGDSSPFQNVKSRASLLAEKIMPRVPTTATEE

SEQ ID NO: 4604 - protein, 56 aa, Cowpox virus
TEYENEYEFYDETQDQSTQLVGYDIKLKTNEDDFVDEFYGYDRSVGVHDYIDESIN

SEQ ID NO: 4605 - protein, 56 aa, Cowpox virus
SNCDLSILLNKASKNVMDRQLSKTPTRQKRSTEMTGNHFCLHKNYGMDTIDDCNSY

SEQ ID NO: 4606 - protein, 56 aa, Cowpox virus
ADVFWISNGMYYEEDDEDGDGRISVANKIYTTDKRRVITSRLKINPVKEEDATTFT

SEQ ID NO: 4607 - protein, 56 aa, Cowpox virus
YDDDVDNGFIGLDKLKLNIVHDIVEPCMPVRRPVAKVLCKEMVNKYFENPLHIIGK

SEQ ID NO: 4608 - protein, 56 aa, Cowpox virus
RTLERDSVYKNERIEQLTNEIKELRDMGGGSNNCSALAEIDKKTIKELRESLDRER

SEQ ID NO: 4609 - protein, 56 aa, Cowpox virus
EDIYNVMTMIEENIANEIETLYKDVRFKQLISSDSMFDIMNCDYLDVKEDAVIDII

SEQ ID NO: 4610 - protein, 56 aa, Cowpox virus
SSMKIDKKRTKFQNRAKMVKEINQTIRAAQTHYETLKQGYLKFKRMIRTATLKDIA

SEQ ID NO: 4611 - protein, 56 aa, Cowpox virus
IRTNNRNGYDYVEFNKKGIAKVTEDKPDNDKRIHAIRLINDSSDVQHIHFGFRNMV

SEQ ID NO: 4612 - protein, 56 aa, Cowpox virus
MSGSQCPMINDDLFRVTLKRMHPLNSEESSMKIDKKRTKFQNRAKMVKEINQTIRA

SEQ ID NO: 4613 - protein, 56 aa, Cowpox virus
VCGMIQSRPNDDTYSLLQRPKIEPEYAEVGNGLPKNNVPVIGNRHSKKYTSTMSKI

SEQ ID NO: 4614 - protein, 56 aa, Cowpox virus
VRNLTIDDMGPIFKEFTTYEDLAIEKYGKPFIRDACVTVLDVQEDRYDYDSDYDSD

SEQ ID NO: 4615 - protein, 56 aa, Cowpox virus
TYLEAIHSDKRISFPMYDELIEQCHLSMERKSKLVDKALNKLESTIDGQSRLSYLP

SEQ ID NO: 4616 - protein, 56 aa, Cowpox virus
GHQKKIDELTYSEYKDIVMDYHRRNGHQSGTYDDVRLSPSSRSGTYDDVRLSSRSG

SEQ ID NO: 4617 - protein, 56 aa, Cowpox virus
MDDDKIRLSKYLYFTDRERINVNTVKQLCETSDPNACYRCGCTALHEYFYNYRSVN

SEQ ID NO: 4618 - protein, 56 aa, Cowpox virus
IRTNNKNGYDYVEFNKKGIAKVTEAKPDNDKRIHAIRLINDSTDVQHIHFGFRNMV

SEQ ID NO: 4619 - protein, 56 aa, Cowpox virus
NGEFEFSTSKELDCLYESYGVSDDVSHCFSSPRRRRSDDKQEYTEMKLLDHAKKDL

SEQ ID NO: 4620 - protein, 56 aa, Cowpox virus
QRLRDRIMDLDRQLNECKRDGNGTSSEEVNRLKTRIRDLERSLEICSKDESELYSA

SEQ ID NO: 4621 - protein, 56 aa, Cowpox virus
FKQLISSDSMFDIMNCDYLDVKEDAVIDIILDWLTEFPEDKDLIRVIRWNNVSQDV

SEQ ID NO: 4622 - protein, 56 aa, Cowpox virus
TVVREIKQQKYGGASRVRTSSSSSDFEDIDTVVREYRQKYGNAMAKGRSSSPKSDP

SEQ ID NO: 4623 - protein, 56 aa, Cowpox virus
STSSGIVTTKSTTDDADLYDTYNDNEPSTVSPTTVENITKSIGKYSTKDYVEVFGI

SEQ ID NO: 4624 - protein, 56 aa, Cowpox virus
EMEDIYDVMTMIEENIANKIETLWKDARFKQLISSDSMFDIMNCDYLDVKEDAVID

SEQ ID NO: 4625 - protein, 56 aa, Cowpox virus
IDTVVREYRQKYGNAMAKGRSSSPKSDPLYSTVKKTTKSLSGGVDIVTKQSDYSLL

SEQ ID NO: 4626 - protein, 39 aa, Human parainfluenza virus 3
RLNKRLNDKKKQGSQPSTNPTNRTNQDEIDDLFNAFGSN

SEQ ID NO: 4627 - protein, 56 aa, Human parainfluenza virus 3
KSEKAHESLLQDINNEFMEITEKIQMASDNTNDLIQSGVNTRLLTIQSHVQNYIPI

SEQ ID NO: 4628 - protein, 56 aa, Human parainfluenza virus 3
MEYWKHTNHGKDAGNELETSMATHGNKLTNKITYILWTIILVLLSIVFIIVLINSI

SEQ ID NO: 4629 - protein, 56 aa, Human parainfluenza virus 3
KSEKAHESLLRDINNEFMEITGKIQMASDNTNDLIQSGVNTRLLTIQSHVQNYIPI

SEQ ID NO: 4630 - protein, 56 aa, Human parainfluenza virus 3
AEGNRSDDRTEQATESDNIKTEQQNIRDRLNKRLNDKKKQGSQPSTNPTNRTNQDE

SEQ ID NO: 4631 - protein, 56 aa, Human parainfluenza virus 3
DEEPEQFEHRADQEQDGEPQSSIIQYAWAEGNRSDDRTEQATESDNIKTEQQNIRD

SEQ ID NO: 4632 - protein, 56 aa, Human parainfluenza virus 3
KSEKAHKSLLQDINNEFMEITEKIQMASDNTNDLIQSGVNTRLLTIQSHVQNYIPI

SEQ ID NO: 4633 - protein, 56 aa, Human parainfluenza virus 3
LMEAQGIDKNIPDLYRHAGNTLENDVQVKSEILSSYNESNATRLIPRKVSSTMRSL

SEQ ID NO: 4634 - protein, 56 aa, Human parainfluenza virus 3
MEYWKHTNHRKDAGNELETSMATHGNKLTNKITYILWTIILVLLSIVLIIVLINSI

SEQ ID NO: 4635 - protein, 56 aa, Human parainfluenza virus 3
KSEKAHESLLQDVNNEFMEVTEKIQMASDNINDLIQSGVNTRLLTIQSHVQNYIPI

SEQ ID NO: 4636 - protein, 56 aa, Human parainfluenza virus 3
KSEKAHESLLRDINNEFIGITEKIQMASDNTNDLIQSGVNTRLLTIQSHVQNYIPI

SEQ ID NO: 4637 - protein, 56 aa, Human parainfluenza virus 3
NNTDRTEQTSTTPPTTTPRSTRTKESIRTNSESKPKTQKTIGKERKDTEESNRFTE

SEQ ID NO: 4638 - protein, 56 aa, Human parainfluenza virus 3
SEISGSDVIFTTEQSRNSDHGRSLEPISTPDTRSMSVVTAATPDDEEEILMKNSRM

SEQ ID NO: 4639 - protein, 56 aa, Human parainfluenza virus 3
DQNESNERVSMIKTKLKEEKIKKTRFDPLMEAQGIDKNIPDLYRHAGNTLENDVQV

SEQ ID NO: 4640 - protein, 56 aa, Human parainfluenza virus 3
KSEILSSYNESNATRLIPRKVSSTMRSLVAVINNSNLPQSTKQSYINELKHCKSDE

SEQ ID NO: 4641 - protein, 56 aa, Human parainfluenza virus 3
QAVARDAEAQMSSTLEDELGVTHEAKESLKRHIRNINSSETSFHKPTGGSAIEMAI

SEQ ID NO: 4642 - protein, 56 aa, Human parainfluenza virus 3
TPDTRSMSVVTAATPDDEEEILMKNSRMKKSSSTHQEDDKRIKKGGGGKGKDWFKK

SEQ ID NO: 4643 - protein, 56 aa, Human parainfluenza virus 3
VYTDAYPLNPTGSIVSSVILDSQKSRVNPVITYSTATERVNELAIRNRTLSAGYTT

SEQ ID NO: 4644 - protein, 56 aa, Human parainfluenza virus 3
SSSDSRAETVVSGGISGSITDSKNGTQNTENIDLNEIRKMDKDSIERKMRQSADVP

SEQ ID NO: 4645 - protein, 56 aa, Human parainfluenza virus 3
MEYWKHTNHGKDAGNELETSMATHGNKLTNKIIYILWTIILVLLSIVFIIVLINSI

SEQ ID NO: 4646 - protein, 56 aa, Human herpesvirus 8
QEQELEEQEQELEEQEQELEEQEQELEEQEQELEEQEQELEEQEQELEEQEQELEE

SEQ ID NO: 4647 - protein, 56 aa, Human herpesvirus 8
QEQELEEQEQELEEQEQELEEQEQELEEQEQELEEQEQEQELEEVEEQEQEQEEQE

SEQ ID NO: 4648 - protein, 56 aa, Human herpesvirus 8
EEQEQELEEQEQELEEQEQELEEQEQELEEQEQELEEQEQELEEQEQELEEQEQEL

SEQ ID NO: 4649 - protein, 56 aa, Human herpesvirus 8
EEQEQELEEQEQELEEQEQELEEQEQELEEQEQELEEQEQELEEQEQELEEQEQEQ

SEQ ID NO: 4650 - protein, 56 aa, Human herpesvirus 8
EQQQDEQQQDEQEQQDEQQQDEQQQQDEQEQQEEQEQQEEQEQELEEQEQELEEQE

SEQ ID NO: 4651 - protein, 56 aa, Human herpesvirus 8
EQEQELEEQEQELEEQEQELEEQEQELEEQEQELEEQEQELEEQEQELEEQEQELE

SEQ ID NO: 4652 - protein, 56 aa, Human herpesvirus 8
EQEVEEQEQEVEEQEQEQEEQELEEVEEQEQEQEEQEEQELEEVEEQEEQELEEVE

SEQ ID NO: 4653 - protein, 56 aa, Human herpesvirus 8
EEQEQELEEQEQELEEQEQELEEQEQEQELEEVEEQEQEQEEQELEEVEEQEQEQE

SEQ ID NO: 4654 - protein, 56 aa, Human herpesvirus 8
QQQEPLQEPQQQEPQQQEPLQEPQQQEPQQQEPQQQEPQQQEPQQQEPQQQEPQQQ

SEQ ID NO: 4655 - protein, 56 aa, Human herpesvirus 8
TPDDDPQPGPSREYRYVLRTSPPHRPGVRMRRVPVTHPKKPHPRYQQPPVPYRQID

SEQ ID NO: 4656 - protein, 56 aa, Human herpesvirus 8
EEQEQQEEQEQELEEQEQELEDQEQELEEQEQELEEQEQELEEQEQELEEQEQELE

SEQ ID NO: 4657 - protein, 56 aa, Human herpesvirus 8
QQEPQQQEPQQQEPQQQEPQQQEPQQQEPQQQEPQQQEPQQQEPQQQEPQQQEPQQ

SEQ ID NO: 4658 - protein, 56 aa, Human herpesvirus 8
PQQQEPLQEPQQQEPQQQEPQQQEPQQQEPQQQEPQQQEPQQQDEQQQDEQQQDEQ

SEQ ID NO: 4659 - protein, 56 aa, Human herpesvirus 8
QREPQQREPQQREPQQREPQQQEPQQREPQQQEPQQQEPQQQEPQQQEPQQQEPQQ

SEQ ID NO: 4660 - protein, 56 aa, Human herpesvirus 8
PQQQEPQQQEPQQQEPQQQEPQQQEPQQQEPQQQDEQQQDEQQQDEQQQDEQQQDE

SEQ ID NO: 4661 - protein, 56 aa, Human herpesvirus 8
QEQELEEQEQELEEQEQELEEQEQEQELEEVEEQEQEQEEQELEEVEEQEQEQEEQ

SEQ ID NO: 4662 - protein, 56 aa, Human herpesvirus 8
PDDDPQPGPSREYRYVLRTSPPHRPGVRMRRVPVTHPKKPHPRYQQPPVPYRQIDD

SEQ ID NO: 4663 - protein, 56 aa, Human herpesvirus 8
EQEQELEEQEQELEEQEQELEEQEQELEEQEVEEQEQEVEEQEQEQEEQELEEVEE

SEQ ID NO: 4664 - protein, 56 aa, Human herpesvirus 8
PQQQEPQQQEPQQQEPQQQEPQQQEPQQQEPLQEPQQQEPQQQEPQQREPQQREPQ

SEQ ID NO: 4665 - protein, 56 aa, Human herpesvirus 8
HEQIASSPPGDNTPDDDPQPGPSREYRYVLRTSPPHRPGVRMRRVPVTHPKKPHPR

SEQ ID NO: 4666 - protein, 56 aa, Human herpesvirus 8; identical to SEQ ID NO: 4646

SEQ ID NO: 4667 - protein, 56 aa, Human herpesvirus 8
QQDEQEQQEEQEQQEEQEQQEEQEQELEEQEQELEEQEQELEEQEQELEEQEQELE

SEQ ID NO: 4668 - protein, 56 aa, Human herpesvirus 8
QDEQQQDEQQQDEQQQDEQQQQDEQQQDEQQQDEQQQDEQEQQDEQQQDEQQQQDE

SEQ ID NO: 4669 - protein, 56 aa, Human herpesvirus 8
SEDEMEVDYPVVSTHEQIASSPPGDNTPDDDPQPGPSREYRYVLRTSPPHRPGVRM

SEQ ID NO: 4670 - protein, 56 aa, Human herpesvirus 8
PVVSTHEQIASSPPGDNTPDDDPQPGPSREYRYVLRTSPPHRPGVRMRRVPVTHPK

SEQ ID NO: 4671 - protein, 56 aa, Human herpesvirus 8
QSSQQQQEPQQQEPQQQEPQQQEPQQQEPQQQEPLQEPQQQEPQQQEPQQQEPQQQ

SEQ ID NO: 4672 - protein, 56 aa, Human herpesvirus 8; identical to SEQ ID NO: 4651

SEQ ID NO: 4673 - protein, 56 aa, Human herpesvirus 8
QQDEQQQDEQEQQDEQQQDEQQQDEQQQQDEQEQQEEQEQQEEQEQQEEQEQELEE

SEQ ID NO: 4674 - protein, 56 aa, Human herpesvirus 8
QDEQEQQEEQEQQEEQEQQEEQEQELEEQEQELEEQEQELEEQEQELEEQEQELEE

SEQ ID NO: 4675 - protein, 56 aa, Human herpesvirus 8
QETVEEPIILHGSSSEDEMEVDYPVVSTHEQIASSPPGDNTPDDDPQPGPSREYRY

SEQ ID NO: 4676 - protein, 56 aa, Human herpesvirus 8
SSEDEMEVDYPVVSTHEQIASSPPGDNTPDDDPQPGPSREYRYVLRTSPPHRPGVR

SEQ ID NO: 4677 - protein, 56 aa, Human herpesvirus 8
SSSEDEMEVDYPVVSTHEQIASSPPGDNTPDDDPQPGPSREYRYVLRTSPPHRPGV

SEQ ID NO: 4678 - protein, 56 aa, Human herpesvirus 8
QQQQDEQQQQDEQQQQDEQQQQDEQEQQEEQEQQEEQEQELEEQEQELEDQEQELE

SEQ ID NO: 4679 - protein, 56 aa, Human herpesvirus 8
QQREPQQREPQQREPQQREPQQREPQQREPQQREPQQREPQQREPQQREPQQREPQ

SEQ ID NO: 4680 - protein, 56 aa, Human herpesvirus 8
QEQELEEQEQELEEQEQELEEQEQELEEQEQELEEQEQELEEQEQELEEQEQEQEL

SEQ ID NO: 4681 - protein, 56 aa, Human herpesvirus 8
QEEQEQQEEQEQQEEQEQQEEQEQELEEQEQELEEQEQELEEQEQELEEQEQELEE

SEQ ID NO: 4682 - protein, 56 aa, Human herpesvirus 8
LHGSSSEDEMEVDYPVVSTHEQIASSPPGDNTPDDDPQPGPSREYRYVLRTSPPHR

SEQ ID NO: 4683 - protein, 56 aa, Human herpesvirus 8
QEPQQQEPQQQEPQQQEPQQQEPQQREPQQREPQQREPQQREPQQREPQQREPQQR

SEQ ID NO: 4684 - protein, 56 aa, Human herpesvirus 8
EDEEDGGDGNKTLSIQSSQQQQEPQQQEPQQQEPQQQEPQQQEPQQQEPQQQEPQQ

SEQ ID NO: 4685 - protein, 56 aa, Human herpesvirus 8; identical to SEQ ID NO: 4646

SEQ ID NO: 4686 - protein, 56 aa, Human herpesvirus 8
PTYRSHLGFWQEGWSGQVYQDWLGRMNCSYENMTALEAVSLNGTRLAAGSPSRSYS

SEQ ID NO: 4687 - protein, 56 aa, Human herpesvirus 8
QELEEQEQELEEQEQELEEQEQELEEQEQEQELEEVEEQEQEQEEQELEEVEEQEQ

SEQ ID NO: 4688 - protein, 56 aa, Human herpesvirus 8
ELEEVEEQEQEQEEQELEEVEEQEQEQEEQEEQELEEVEEQEEQELEEVEEQEEQE

SEQ ID NO: 4689 - protein, 56 aa, Human herpesvirus 8
DDDPQPGPSREYRYVLRTSPPHRPGVRMRRVPVTHPKKPHPRYQQPPVPYRQIDDC

SEQ ID NO: 4690 - protein, 56 aa, Human herpesvirus 8
EEVEEQEQEQEEQELEEVEEQEQEQEEQEEQELEEVEEQEEQELEEVEEQEEQELE

SEQ ID NO: 4691 - protein, 56 aa, Human herpesvirus 8
DEQQQDEQQQDEQQQDEQQQDEQQQDEQEQQDEQEQQDEQEQQDEQQQDEQQQQDE

SEQ ID NO: 4692 - protein, 56 aa, Human herpesvirus 8
IKSITVYAPVEEKQRMHVLLDEVKKQRANTETALELEAAATHGDDARLLQRAVDEL

SEQ ID NO: 4693 - protein, 56 aa, Human herpesvirus 8
KTLSIQSSQQQQEPQQQEPQQQEPQQQEPQQQEPLQEPQQQEPQQQEPQQQEPQQQ

SEQ ID NO: 4694 - protein, 56 aa, Human herpesvirus 8
EPQQQEPQQQEPQQQEPQQREPQQREPQQREPQQREPQQREPQQREPQQREPQQRE

SEQ ID NO: 4695 - protein, 56 aa, Human herpesvirus 8
QQEPQQQEPQQQEPLQEPQQQEPQQQEPQQQEPQQQEPQQQEPQQQEPQQQEPQQQ

SEQ ID NO: 4696 - protein, 33 aa, Human herpesvirus 8
DPIRVSEKGMLLEQSQSPYPALKKKKKNKEAIY

SEQ ID NO: 4697 - protein, 56 aa, Human herpesvirus 8
QQQEPQQQEPQQQEPQQQEPQQQEPQQQEPQQQEPQQQEPQQQEPQQREPQQREPQ

SEQ ID NO: 4698 - protein, 56 aa, Human herpesvirus 8
PTYRSHLGFWQEGWSGQVYQDWLGRMNCSYENMTALEAVSLNGTRLAAGSPSSEYP

SEQ ID NO: 4699 - protein, 56 aa, Human herpesvirus 8
LEEVEEQEQQGVEQQEQETVEEPIILHGSSSEDEMEVDYPVVSTHEQIASSPPGDN

SEQ ID NO: 4700 - protein, 56 aa, Human herpesvirus 8
LEEVEEQEQEQEEQELEEVEEQEQEQEEQEEQELEEVEEQEEQELEEVEEQEEQEL

SEQ ID NO: 4701 - protein, 56 aa, Human herpesvirus 8
EQQDEQEQQDEQEQQDEQQQDEQQQQDEQQQQDEQQQQDEQQQQDEQQQQDEQEQQ

SEQ ID NO: 4702 - protein, 56 aa, Human herpesvirus 8; identical to SEQ ID NO: 4646

SEQ ID NO: 4703 - protein, 56 aa, Human herpesvirus 8
VEQQEQETVEEPIILHGSSSEDEMEVDYPVVSTHEQIASSPPGDNTPDDDPQPGPS

SEQ ID NO: 4704 - protein, 56 aa, Human herpesvirus 8
PTYRSHLGFWQEGWSGQVYQDWLGRINCSYENMTAIEAVSLNGTRLAAGSPSSEYP

SEQ ID NO: 4705 - protein, 56 aa, Human herpesvirus 8
EPQQREPQQREPQQREPQQREPQQREPQQQEPQQQEPQQQEPQQQEPQQQEPQQQE

SEQ ID NO: 4706 - protein, 56 aa, Human herpesvirus 8
QQQDEQQQDEQQQDEQEQQDEQQQDEQQQQDEQEQQEEQEQQEEQEQQEEQEQEQQ

SEQ ID NO: 4707 - protein, 56 aa, Human herpesvirus 8
EQEEQELEEVEEQEEQELEEVEEQEEQELEEVEEQEQQGVEQQEQETVEEPIILHG

SEQ ID NO: 4708 - protein, 56 aa, Human herpesvirus 8
QQQDEQQQDEQQQDEQEQQDEQQQDEQQQQDEQEQQEEQEQQEEQQQDEQQQDEQQ

SEQ ID NO: 4709 - protein, 56 aa, Human herpesvirus 8
QEQEQEEQEEQELEEVEEQEEQELEEVEEQEEQELEEVEEQEQQELEEVEEQEQQG

SEQ ID NO: 4710 - protein, 56 aa, Human herpesvirus 8
QEQQEEQEQQEEQEQELEEQEQELEEQEQELEEQEQELEEQEQELEEQEQELEEQE

SEQ ID NO: 4711 - protein, 56 aa, Human herpesvirus 8
QQDEQEQQDEQEQQDEQQQDEQQQDEQQQQDEQEQQEEQEQQEEQEQQEEQEQELE

SEQ ID NO: 4712 - protein, 56 aa, Human herpesvirus 8
NVSVSVEDMSASGSGEDAIDESGSGEEERPMTSHVTFMTQSVQATTELTDALISAF

SEQ ID NO: 4713 - protein, 56 aa, Human herpesvirus 8
QQDEQEQQEEQEQQEEQQQDEQQQDEQQQDEQQQDEQEQQDEQQQDEQQQQDEQEQ

SEQ ID NO: 4714 - protein, 56 aa, Human herpesvirus 8
EVEEQEQQGVEQQEQETVEEPIILHGSSSEDEMEVDYPVVSTHEQIASSPPGDNTP

SEQ ID NO: 4715 - protein, 56 aa, Human herpesvirus 8
DGNKTLSIQSSQQQQEPQQQEPQQQEPQQQEPQQQEPQQQEPLQEPQQQEPQQQEP

SEQ ID NO: 4716 - protein, 56 aa, Human herpesvirus 8
GNKTLSIQSSQQQQEPQQQEPQQQEPQQQEPQQQEPQQQEPQQQEPQQQEPQQREP

SEQ ID NO: 4717 - protein, 56 aa, Human herpesvirus 8
GDNTPDDDPQPGPSREYRYVLRTSPPHRPGVRMRRVPVTHPKKPHPRYQQPPVPYR

SEQ ID NO: 4718 - protein, 30 aa, Human herpesvirus 8
SDILTTLSSTTETAAPAVADARKPPSGKKK

SEQ ID NO: 4719 - protein, 56 aa, Human herpesvirus 8
PQQQEPQQQEPQQQEPQQQEPQQQEPQQQEPQQQEPQQQDEQQQDEQQQDEQQQDE

SEQ ID NO: 4720 - protein, 56 aa, Human herpesvirus 8
PQQQEPLQEPQQQEPQQQEPQQQEPQQQEPLQEPQQQEPQQQEPQQQEPQQQEPQQ

SEQ ID NO: 4721 - protein, 56 aa, Human herpesvirus 8
EPLQEPQQQEPQQQEPQQQEPQQQEPQQQDEQQQDEQQQDEQQQDEQQQQDEQQQD

SEQ ID NO: 4722 - protein, 56 aa, Human herpesvirus 8
QQQDEQQQDEQQQDEQQQDEQQQDEQQQDEQQQDEQQQDEQQQDEQQQDEQQQDEQ

SEQ ID NO: 4723 - protein, 56 aa, Human herpesvirus 8
QEPQQQEPQQQDEQQQDEQQQDEQQQDEQQQDEQQQDEQQQDEQEQQDEQQQDEQQ

SEQ ID NO: 4724 - protein, 56 aa, Human herpesvirus 8
QEPLQEPQQQEPQQQEPQQREPQQREPQQREPQQREPQQREPQQREPQQQEPQQRE

SEQ ID NO: 4725 - protein, 56 aa, Human herpesvirus 8
REYRYVLRTSPPHRPGVRMRRVPVTHPKKPHPRYQQPPVPYRQIDDCPAKARPQHI

SEQ ID NO: 4726 - protein, 56 aa, Human herpesvirus 8
EQEEQEEQELEEVEEQEEQELEEVEEQEEQELEEVEEQEQQGVEQQEQETVEEPII

SEQ ID NO: 4727 - protein, 56 aa, Human herpesvirus 8
QEQELEEVEEQEQEQEEQELEEVEEQEQEQEEQEEQELEEVEEQEEQELEEVEEQE

SEQ ID NO: 4728 - protein, 56 aa, Human herpesvirus 8
QEEQELEEVEEQEEQELEEVEEQEEQELEEVEEQEQQGVEQQEQETVEEPIILHGS

SEQ ID NO: 4729 - protein, 56 aa, Human herpesvirus 8
PQQREPQQQDEQQQDEQQQDEQQQDEQQQDEQQQDEQQQDEQQQDEQQQDEQQQDE

SEQ ID NO: 4730 - protein, 56 aa, Human herpesvirus 8
PGVRMRRVPVTHPKKPHPRYQQPPVPYRQIDDCPAKARPQHIFYRRFLGKDGRRDP

SEQ ID NO: 4731 - protein, 56 aa, Human herpesvirus 8
HALPVISPPAHRPSPIPHLPAPQVTEPKGVLQSKRGTLVLRPAAVIDPRKPVSAPI

SEQ ID NO: 4732 - protein, 56 aa, Human herpesvirus 8
EPQQQEPQQQEPQQQDEQQQDEQQQDEQQQDEQQQDEQEQQDEQQQDEQQQDEQQQ

SEQ ID NO: 4733 - protein, 56 aa, Human herpesvirus 8
EQEEQELEEVEEQEQQELEEVEEQEQQGVEQQEQETVEEPIILHGSSSEDEMEVDY

SEQ ID NO: 4734 - protein, 56 aa, Human herpesvirus 8
QEQELEEQEQEQELEEVEEQEQEQEEQELEEVEEQEQEQEEQEEQELEEVEEQEEQ

SEQ ID NO: 4735 - protein, 56 aa, Human herpesvirus 8
ELEEVEEQEEQELEEVEEQEQQGVEQQEQETVEEPIILHGSSSEDEMEVDYPVVST

SEQ ID NO: 4736 - protein, 56 aa, Human herpesvirus 8
LEEVEEQEQEQEEQEEQELEEVEEQEEQELEEVEEQEEQELEEVEEQEQQGVEQQE

SEQ ID NO: 4737 - protein, 56 aa, Human herpesvirus 8
TTGGLYLVWQPMSAINLTHAQGDSGNPTSSPPPSASPMTTSASRRKRRSASTAAAG

SEQ ID NO: 4738 - protein, 56 aa, Human herpesvirus 8
TSVTETPGPEPNPPARPDREPPPTPPATPGATALLSDLTATRGQKRKFSSLKESYP

SEQ ID NO: 4739 - protein, 56 aa, Human herpesvirus 8
EEQELEEVEEQEEQELEEVEEQEEQELEEVEEQEQQGVEQQEQETVEEPIILHGSS

SEQ ID NO: 4740 - protein, 56 aa, Human herpesvirus 8
QQEPQQQEPQQQEPLQEPQQQEPQQQEPQQQEPLQEPQQQEPQQQEPLQEPQQQEP

SEQ ID NO: 4741 - protein, 49 aa, Human herpesvirus 8
PETTHTPCAAVEKDAPTPNPTSNRVEASSRSSPKSKIRKMFCEELLNKQ

SEQ ID NO: 4742 - protein, 56 aa, Human herpesvirus 8
TPGGQDSLGVSGSSITTLSSGPHSLSPASDILTTLSSTTETAAPAVADARKPPSGK

SEQ ID NO: 4743 - protein, 56 aa, Human herpesvirus 8
KLITGPLSKRHTLFPSPPNVTLAQCFEAAGMLPHQKMMVSEMIWPSIEPKDWIEPN

SEQ ID NO: 4744 - protein, 30 aa, Human herpesvirus 8
KRRTRLLMEKHTEIPLAKRVALRAGKGLCP

SEQ ID NO: 4745 - protein, 56 aa, Human herpesvirus 8
KLSLSDYKLDTVAKQCLGRQKDDISYKDIPPLFKSGPDGRAKVGNYCVIDSVLVMD

SEQ ID NO: 4746 - protein, 56 aa, Human herpesvirus 8
DEQQQDEQQQDEQQQDEQQQDEQQQDEQQQDEQEQQDEQEQQDEQQQDEQQQDEQQ

SEQ ID NO: 4747 - protein, 56 aa, Human herpesvirus 8
QQQEPQQQEPQQQEPQQQEPQQQEPQQQDEQQQDEQQQDEQQQDEQQQDEQQQDEQ

SEQ ID NO: 4748 - protein, 56 aa, Human herpesvirus 8
QREPQQREPQQREPQQREPQQREPQQREPQQREPQQQDEQQQDEQQQDEQQQDEQQ

SEQ ID NO: 4749 - protein, 56 aa, Human herpesvirus 8
VYERGGRQEDDWLPIPLSFPEEPVPPPPSLVFMDDLFINTKQCDFVDTLEAACRTQ

SEQ ID NO: 4750 - protein, 56 aa, Human herpesvirus 8
PVAPIPSPAPATPLPPPALLPPVTTSSSPIPPSHPVSPGTTDTHSPSPALPPTQSP

SEQ ID NO: 4751 - protein, 56 aa, Human herpesvirus 8
QDEQQQDEQQQDEQQQDEQQQDEQQQDEQQQDEQQQDEQQQDEQQQDEQQQDEQQQ

SEQ ID NO: 4752 - protein, 56 aa, Human herpesvirus 8
YSFYAHGVKQGHEEFLRDLRELPVSQELISEMSSEDVLGQEGDTDAFYLTASLPPS

SEQ ID NO: 4753 - protein, 56 aa, Human herpesvirus 8
QDEQQQDEQEQQDEQQQDEQQQQDEQEQQEEQEQQEEQEQQEEQEQQEEQEQELEE

SEQ ID NO: 4754 - protein, 56 aa, Human herpesvirus 8
RRPRRPTANEDNIELTVLVGPAGGTDEEPTDESSEGDVASGDKERDGSSGDEPDGG

SEQ ID NO: 4755 - protein, 45 aa, Human herpesvirus 7
INLEKEFSALSDTESEEELQLEKPLLNKQDSSVSLTQKKLENQSK

SEQ ID NO: 4756 - protein, 56 aa, Human herpesvirus 7
TDVSNIATFNDNNLKNLLNSRKRDPLFQNFSFTEKMQPVRSPFFLPNAEIQDFDSG

SEQ ID NO: 4757 - protein, 56 aa, Human herpesvirus 7
NFSFTEKMQPVRSPFFLPNAEIQDFDSGSLLTGKETQNTIFGASKAQENGDKDLID

SEQ ID NO: 4758 - protein, 56 aa, Human herpesvirus 7
MGSKCCKTIHGGIFSKAEDTLVDYKGKYINLEKEFSALSDTESEEELQLEKPLLNK

SEQ ID NO: 4759 - protein, 55 aa, Human herpesvirus 7
SLLTGKETQNTIFGASKAQENGDKDLIDLENSVQKDDDIVNKLVSHLTHSEEDVV

SEQ ID NO: 4760 - protein, 56 aa, Human herpesvirus 7
LSKLDLHNSNKVIDIVSSPKVNVVQLPKNKIDYHSTFFLPENEVNRQNGVQSRDQL

SEQ ID NO: 4761 - protein, 56 aa, Human herpesvirus 7
VKKLLTDFTDTISLEERSLKDVLEPPKKTDVSNIATFNDNNLKNLLNSRKRDPLFQ

SEQ ID NO: 4762 - protein, 56 aa, Human herpesvirus 7
FKLPSEKRRKEIVHENLQSFDDEHNEMSLPPQDQKSIKQKNGNKANSSTKTLNMIG

SEQ ID NO: 4763 - protein, 56 aa, Human herpesvirus 7
MGVDPHNESEARKSLYDHSRVDSDAFVATTNPWASQEGSLSDVLYNINHRDQLGYN

SEQ ID NO: 4764 - protein, 56 aa, Human herpesvirus 7
TEPQGDDITHTNEYSQVEALKMLKAIKLLDESYKKAEIAEAKKSQRPSLLERIQYR

SEQ ID NO: 4765 - protein, 56 aa, Human herpesvirus 7
NKIDYHSTFFLPENEVNRQNGVQSRDQLSKNSTNDLQKILELRERIKTIKQNNEDI

SEQ ID NO: 4766 - protein, 56 aa, Human herpesvirus 7
SLYNLKRNEETYQDKNSLNFSNEFPHTTFSRRDKKTDNQAGILMERSVTEEICVNN

SEQ ID NO: 4767 - protein, 56 aa, Human herpesvirus 7
FSRRDKKTDNQAGILMERSVTEEICVNNSLTFSNEFPPTFSRTDKKTNSPAGILME

SEQ ID NO: 4768 - protein, 56 aa, Human herpesvirus 7
NNTLSKDLFVGSEDGLLSSVKKDSMILDEPRNSTSINNSKKMHRILQTEILDLTDQ

SEQ ID NO: 4769 - protein, 56 aa, Human herpesvirus 7
SPLPLTPKPDVQESNQRAPTKLINFKRLLEKNDKDISASDIEFIKQSSRCTVSTAL

SEQ ID NO: 4770 - protein, 38 aa, Human herpesvirus 7
LDESYKKAEIAEAKKSQRPSLLERIQYRGYQKLSTEEL

SEQ ID NO: 4771 - protein, 56 aa, Human herpesvirus 7
KHTRVSSAIPTFPLSLRETPPEARSPAVLAAATQSHKTRAISTHNATTTIRIPRLP

SEQ ID NO: 4772 - protein, 56 aa, Human herpesvirus 7
NLMFLENKTKVTKPTAIPNAVTSEPTKFFPSTRGTSSMQASQQTSSFPTTFFTTNH

SEQ ID NO: 4773 - protein, 56 aa, Human herpesvirus 7
QVKDDPKFERQAKTEEKGEKNHKVEEGNNFFCKQETQHKITSYMVPTKNGGTGTNF

SEQ ID NO: 4774 - protein, 56 aa, Human herpesvirus 7
LPPQDQKSIKQKNGNKANSSTKTLNMIGTNDVNASMKEKESASSAKKNQLVKDVKW

SEQ ID NO: 4775 - protein, 56 aa, Human herpesvirus 7
NVKPENAFSEIALMPISHDKIIDVNNSNIQVLETELAHTNLFVYSAIAQKYDLPLK

SEQ ID NO: 4776 - protein, 56 aa, Human herpesvirus 7
DDEYDEDKPPRQVDPDRVDNILMESDFFNVKPENAFSEIALMPISHDKIIDVNNSN

SEQ ID NO: 4777 - protein, 56 aa, Human herpesvirus 7
DGKDLIIPDKFPNETFYIRDKKKDISTNRAVERSTADVDTESDVEKVAAEGLILLE

SEQ ID NO: 4778 - protein, 56 aa, Human herpesvirus 7
ICHDNGKLHLTYITVLKSGLDCDIKDQKLEKLFEKEHAERKKQDDDYKKKALKQKD

SEQ ID NO: 4779 - protein, 56 aa, Human herpesvirus 7
KNCLWFLRKTHKVNIPDTGMKKDENKELTKQASYCFNNHFIPIRSNDEEYRRENVS

SEQ ID NO: 4780 - protein, 56 aa, Human herpesvirus 7
VLQATQSVQAQVKEPLDSSPPYLKTNKDTEPQGDDITHTNEYSQVEALKMLKAIKL

SEQ ID NO: 4781 - protein, 56 aa, Hepatitis B virus
QHFRKLLLLDEEAGPLEEELPRLADEGLNRRVAEDLNLGNLNVSIPWTHKVGNFTG

SEQ ID NO: 4782 - protein, 56 aa, Hepatitis B virus
HQDIINKCEQFVGPLTVNEKRRLNLVMPARFFPISTKYLPLEKGIKPYYPENVVNH

SEQ ID NO: 4783 - protein, 56 aa, Hepatitis B virus
GTVGVEPSSSGHTHNCANSSSSCLHQSAVRKEAYSPVSTSKRHSSSGNAVELHHVP

SEQ ID NO: 4784 - protein, 56 aa, Hepatitis B virus
HQDIITKCEQFVGPLTVNEKRRLKLVMPARFFPNSTKYLPLDKGIKPYYPENVVNH

SEQ ID NO: 4785 - protein, 56 aa, Hepatitis B virus
LQPQQGSLAKGKSGQSGSIRARVHPTTLQSFGVEPSGSGHIDNGASSTSSCLLQSA

SEQ ID NO: 4786 - protein, 56 aa, Hepatitis B virus
HQDIINKCEQFVGPLTVNEKRRLNLVMPARFFPISTKYLPLEKGIKPYYPDNVVNH

SEQ ID NO: 4787 - protein, 56 aa, Hepatitis B virus
LHSKPTQKIQIGTSIRTRTTGRTPTRWEWEHSGQGSSLPMGDCWGGALRLRAYSQL

SEQ ID NO: 4788 - protein, 56 aa, Hepatitis B virus
ADEGLNRRVAEDLNLGNPNVSIPWTHKVGNFTGLYSSTVPCFNPTWQTPSFPDIHL

SEQ ID NO: 4789 - protein, 56 aa, Hepatitis B virus
MGGWSSKPRKGMGTNLSVPNPLGFFPDHQLDPAFGANSNNPDWDFNPIKDHWPAAN

SEQ ID NO: 4790 - protein, 56 aa, Hepatitis B virus; identical to SEQ ID NO: 4789

SEQ ID NO: 4791 - protein, 56 aa, Hepatitis B virus
MGGWSPKPRKGMGTNLSVPNPLGFFPDHQLATNRQSGRQPTPISPPLRDSHPQAMQ

SEQ ID NO: 4792 - protein, 56 aa, Hepatitis B virus
HLHEDIANKCQQFVGPLTVNEKRRLKLIMPARFYPNSTKYLPLDKGIKPYYPDHVV

SEQ ID NO: 4793 - protein, 56 aa, Hepatitis B virus
KVGNFTGLYSSTVPIFNPEWQTPAFPKIHLHEDIANKCQQFVGPLTVNEKRRLKLI

SEQ ID NO: 4794 - protein, 56 aa, Hepatitis B virus; identical to SEQ ID NO: 4789

SEQ ID NO: 4795 - protein, 56 aa, Hepatitis B virus
KVGNFTGLYSSTVPIFNPEWQTPSFPKIHLQEDIINRCQQFVGPLTVNEKRRLKLI

SEQ ID NO: 4796 - protein, 56 aa, Hepatitis B virus
MGGWSSKPRKGMGTNLSVPNPLGFFPDHQLDPAFKANSENPDWDLNPHKDNWPDAN

SEQ ID NO: 4797 - protein, 56 aa, Hepatitis B virus
KVGNFTGLYSHTVPIFNPEWQTPSFPKIHLQEDIIDRCQQFVGPLTVNEKRRLKLI

SEQ ID NO: 4798 - protein, 56 aa, Hepatitis B virus
HLQEDIIDRCQQFVGPLTVNEKRRLKLIMPARFYPNSTKYLPLDKGIKPYYPEHVV

SEQ ID NO: 4799 - protein, 56 aa, Hepatitis B virus
RLADADLNRRVAEDLNLGNLNVSIPWTHKVGNFTGLYSSTVPIFNPEWQTPSFPKI

SEQ ID NO: 4800 - protein, 56 aa, Hepatitis B virus
MGGWSSKPRKGMGTNLSVPNPLGFFPDHQLDPAFGANSNNPDWDFNPIKDNWPAAN

SEQ ID NO: 4801 - protein, 56 aa, Hepatitis B virus
HLQEDIINRCQQFVGPLTVNEKRRLKLIMPARFYPTHTKYLPLDKGIKPYYPDQVV

SEQ ID NO: 4802 - protein, 56 aa, Hepatitis B virus
MGGWSSKPRKGMGTNLSVPNPLGFFPDHQLDPAFGANSNNPDWDFNPVKDDWPAAN

SEQ ID NO: 4803 - protein, 35 aa, Hepatitis B virus
IDHSVNNSSSCLQQSAIRKAAYSHLSNSKRQSSSG

SEQ ID NO: 4804 - protein, 56 aa, Hepatitis B virus
ADEDLNRRVAEDLNLQLPNVSIPWTHKVGNFTGLYSSTIPVFNPNWKTPSFPDIHL

SEQ ID NO: 4805 - protein, 56 aa, Hepatitis B virus
MGGWSSKPRKGMGTNLSVPNPLGFFPDHQLDLAFRANSNNPDWDFNPNKDPWPQAH

SEQ ID NO: 4806 - protein, 56 aa, Hepatitis B virus; identical to SEQ ID NO: 4801

SEQ ID NO: 4807 - protein, 56 aa, Hepatitis B virus
FCSQSSGILSRSPVGPGVQSQLKQSRLGLQPQQGSLARGKSGHAVELHNIPPSSAR

SEQ ID NO: 4808 - protein, 56 aa, Hepatitis B virus
HLQGDIINRCQQFVGPLTVNEKRRLKLIMPARFYPTHTKYLPLDKGIKPYYPDQVV

SEQ ID NO: 4809 - protein, 56 aa, Hepatitis B virus
LYKRETSRSASFCGSPYTWEQDLQHGAFLDGPSRVGKEPFHQQSSRIPSRSPVGPS

SEQ ID NO: 4810 - protein, 56 aa, Hepatitis B virus
MGGWSSKPRKGMGTNLSVPNPLGFFPDHQLDPAFKANSENPDWGSPQAQGILTTVP

SEQ ID NO: 4811 - protein, 56 aa, Hepatitis B virus
MGGWYSKPRKGMGTNLSVPNPLGFFPDHQLDPAFKAKSDNPDWDLNPHKDNWPDSN

SEQ ID NO: 4812 - protein, 56 aa, Hepatitis B virus
ADEGLNRRVAEDLNLGDLNVSIPWTHKVGNFTGLYSSTVPCFNPQWQTPSFPSIHL

SEQ ID NO: 4813 - protein, 56 aa, Hepatitis B virus
IPLHPAAMPHLLVGSSGLSGYVARLSSNSRILNHQHGIMPNLHDSCSRNLYVSLLL

SEQ ID NO: 4814 - protein, 56 aa, Hepatitis B virus
KVGNFTGLYSSTVPIFNPEWQTPSFPKIHLHEDIANRCQQFVGPLTVNEKRRLKLI

SEQ ID NO: 4815 - protein, 56 aa, Hepatitis B virus; identical to SEQ ID NO: 4795

SEQ ID NO: 4816 - protein, 56 aa, Hepatitis B virus
TRKGMGTNLSVPNPLGFFPDHQLDPAFEANSDNPDWDLNPHKDNWPDANKVGVGAF

SEQ ID NO: 4817 - protein, 56 aa, Hepatitis B virus
MGQNHSVTNPLGFFPEHQLDPLFRANSKHPDWDFNPSKDNWPEATKVGVGAFGPGF

SEQ ID NO: 4818 - protein, 56 aa, Hepatitis B virus; identical to SEQ ID NO: 4801

SEQ ID NO: 4819 - protein, 56 aa, Hepatitis B virus
MAARVCCQLDPARDVLCLRPVGAESRGRPVSGPFGALPSPSSSAVPADHGAHLSLR

SEQ ID NO: 4820 - protein, 56 aa, Hepatitis B virus
VREKANPSLSTSKRHTSTGNAVELNPVPPSSVGSQGKGSVLPCWWLQFRDTEPCSD

SEQ ID NO: 4821 - protein, 56 aa, Hepatitis B virus
NEVGAGAFGPGLTPPHGGLLGWSPQAQGKLITMPANPPPASNKRQSGRQPTPLSPP

SEQ ID NO: 4822 - protein, 56 aa, Hepatitis B virus
MGGYSSKPRKGMGTNLSVPNPLGFLPDHQLDPAFGANSNNPDWDFNPNKDPWPEAW

SEQ ID NO: 4823 - protein, 56 aa, Hepatitis B virus
KVGNFTGLYSSTAPIFNPEWQTPSFPKIHLQEDIINRCQQFVGPLTVNEKRRLKLI

SEQ ID NO: 4824 - protein, 56 aa, Hepatitis B virus
HLHEDIINRCQQFVGPLNVNEKRRLKLIMPARFYPNSTKYLPLDKGIKPYYPGHVV

SEQ ID NO: 4825 - protein, 56 aa, Hepatitis B virus
ADEGLNHRVAEDLNLGNPNVDIPWTHKVGNFTGLYSSTVPVFNPEWQTPSFPDIHL

SEQ ID NO: 4826 - protein, 56 aa, Hepatitis B virus
ADQDLNHRVAEDLNLGNPNVSIPWTHKVGNFTGLYSSTVPVFNPEWQTPSFPNIHL

SEQ ID NO: 4827 - protein, 56 aa, Hepatitis B virus
LQPQQGSLARGKSGRSGSIWSRVHPTTRRPFGVEPSGSGHIDNTASSTSSCLHQSA

SEQ ID NO: 4828 - protein, 56 aa, Hepatitis B virus
KVGNFTGLYSSTVPIFNPEWQTPSFPNIHLQEDIINRCQQFVGPLTVNEKRRLKLI

SEQ ID NO: 4829 - protein, 56 aa, Hepatitis B virus
RLADADLNRRVAEDLNLGNLNVSIPWTHKVGNFTGLYSSTVPIFNPEWQTPSFPNI

SEQ ID NO: 4830 - protein, 56 aa, Hepatitis B virus
MGGWSSKPRKGMGTNLSVPNPLGFFPDHQLDPVFGANSNNPDWDFNPIKDHWPAAN

SEQ ID NO: 4831 - protein, 56 aa, Hepatitis B virus
MQSRLGRQTRSIPLAVGPSSRSAFGVDPFRPSTIDSFAVEPSCCRHIDKSASHASS

SEQ ID NO: 4832 - protein, 56 aa, Hepatitis B virus
MGGWSSKPRKGMGTNLSVPNPLGFFPDHQLDPAFGANSNNPDWDFNPIKDHWPAAK

SEQ ID NO: 4833 - protein, 14 aa, Hepatitis B virus
MDIDKYKEFGASVE

SEQ ID NO: 4834 - protein, 56 aa, Hepatitis B virus
MGGWSSKHGQGMGTNLSNPNPRGFYPDHQLDPAVKANSNNPDGDFNTNKDHGPEAN

SEQ ID NO: 4835 - protein, 56 aa, Hepatitis B virus
MPLSYQRFRKLLLLDGDAGPLEEELPRLADEGLNRRVAEDLNLGNPNVSIPWTHKV

SEQ ID NO: 4836 - protein, 56 aa, Hepatitis B virus
DWQTPSFPNIHLHQDIITKCEQFVGPLTVNEKRRLKLVMPARFFPNSTKYLPLDKG

SEQ ID NO: 4837 - protein, 56 aa, Hepatitis B virus
CGSPYSWEQELQHGRLVFQTSKRHGDESFCSQSSGILSRSPVGPCIRSQLKQSRLG

SEQ ID NO: 4838 - protein, 56 aa, Hepatitis B virus; identical to SEQ ID NO: 4796

SEQ ID NO: 4839 - protein, 56 aa, Hepatitis B virus
MGGYSSKPRKGMGTNLSVPNPLGFLPDHQLDPAFGANSNNPDWDSGSGHIDNSASS

SEQ ID NO: 4840 - protein, 56 aa, Hepatitis B virus
ADEGLNRRVAEDLNLGDLNVNIPWTHKVGNFTGLYSSTVPVFNPEWQTPSFPNIHL

SEQ ID NO: 4841 - protein, 56 aa, Hepatitis B virus
RLADADLNRRVAEDLNLGNLNVSIPWTHKVGNFTGLYSSTAPIFNPEWQTPSFPKI

SEQ ID NO: 4842 - protein, 56 aa, Hepatitis B virus
LDPAFRANTRNPDWDHNPNKDHWTEANKVGVGAFGPGFTPPHGGLLGWSPQAQGML

SEQ ID NO: 4843 - protein, 56 aa, Hepatitis B virus; identical to SEQ ID NO: 4795

SEQ ID NO: 4844 - protein, 56 aa, Hepatitis B virus
KVGNFTGLYSSTVPVFNPEWQTPSFPKIHLQEDIINRCQQFVGPLTVNEKRRLKLI

SEQ ID NO: 4845 - protein, 56 aa, Aichivirus A
MDELVDAIVTRLDRSTGVSNSLASLIKRQGNRVIDAEPREIPLEYADDLLEAMAHH

SEQ ID NO: 4846 - protein, 56 aa, Aichivirus A
QYDEQNEVLSPESLCGEGAEPCWKCSQDKPRRKYNTVPPEEWLYDSDVQSWFYPET

SEQ ID NO: 4847 - protein, 56 aa, Aichivirus A
GIRRQGLLTLSADTETNQTLNKITESVNQAAQVVSQFDLSGPANSVSFAASDIREA

SEQ ID NO: 4848 - protein, 56 aa, Aichivirus A
THTVSGSSNKVGSRFSKWWEPAAARALERATDSAIDGIDAAGKAASKAITRKLDRP

SEQ ID NO: 4849 - protein, 56 aa, Aichivirus A
VSTGLGDGPVSASADSLPGRSGGASSEKTHTVSGSSNKVGSRFSKWWEPAAARALE

SEQ ID NO: 4850 - protein, 56 aa, Aichivirus A
QGNRVIDAEPREIPLEYADDLLEAMAHHRPVPCSLGLSQAIANNTPLQQIIDTFWK

SEQ ID NO: 4851 - protein, 56 aa, Aichivirus A
LFDEPEPGVFVPKPELQVEIDRTLEDPDYVYSTFLKDELRPTAKVKDGLTRIVEAA

SEQ ID NO: 4852 - protein, 56 aa, Aichivirus A
KPRRKYNTVPPEEWLYDSDVQSWFYPETYYSDLQQKFFDKLALLSLPGAYQAKTPE

SEQ ID NO: 4853 - protein, 56 aa, Aichivirus A
RATDSAIDGIDAAGKAASKAITRKLDRPAAPSSTANPQPSLIALNPSATQSGNASI

SEQ ID NO: 4854 - protein, 56 aa, Aichivirus A
PKPELQAEINQTLEDPDYVYSTFLKDELRPTNKVEQGLTRIVEAAPIHAIVAGRML

SEQ ID NO: 4855 - protein, 56 aa, Aichivirus A
TVSVGVGDAPVSASADQLPGRPGGASSDKAHSSPSSKTTIETGNRVGSRFSKWWEP

SEQ ID NO: 4856 - protein, 56 aa, Aichivirus A
PRRKYNIVPPEDWLLDSNVQDWFEPPTYLSDFQQRVFDKIALLSLPGPFQAKTPEE

SEQ ID NO: 4857 - protein, 56 aa, Aichivirus A
KAHSSPSSKTTIETGNRVGSRFSKWWEPAAARALERATDAACDGIEGAGKLAGKAI

SEQ ID NO: 4858 - protein, 56 aa, Aichivirus A
AAPSSTANPQPSLIALNPSATQSGNASILTGSTAPSFLAYPTATPVPLPNPDEPSQ

SEQ ID NO: 4859 - protein, 56 aa, Aichivirus A
CDEEHGFLSPESLCGEGFEPCHRCTNPPPRRKYNIVPPEDWLLDSNVQDWFEPPTY

SEQ ID NO: 4860 - protein, 56 aa, Aichivirus A
SRKLAGPTPASSTATPQPGLAALNPSATQAGNAAILTGSTAPSFLAYPTASSVPLP

SEQ ID NO: 4861 - protein, 56 aa, Aichivirus A
QAGNAAILTGSTAPSFLAYPTASSVPLPNPDEPSMPGPSGDRTWLLDTVTWEQSQQ

SEQ ID NO: 4862 - protein, 56 aa, Aichivirus A
WKSRQDTPQETQAAYSAIPHQKSKPKSQKPVPTRHIQRQGISPAVPGISNNVVHVE

SEQ ID NO: 4863 - protein, 56 aa, Aichivirus A
YYSDLQQKFFDKLALLSLPGAYQAKTPEERALAGALTQLLNFPTTPQLSIPTTNLQ

SEQ ID NO: 4864 - protein, 56 aa, Aichivirus A
LTGSTAPSFLAYPTATPVPLPNPDEPSQPGPSGDRTWLLDTVTWSQEFTRGWNIAG

SEQ ID NO: 4865 - protein, 56 aa, Aichivirus A
NRTLTRISESVTQATQAVTNFDLQGPANSVTLAASDIREAATRVASSLDGFTDVLH

SEQ ID NO: 4866 - protein, 56 aa, Aichivirus A
SPAYGAFPIKKQPAPLRRNDRRLQEGVDLDTQLFLKHGKGDVTEPWPGLEAAADLY

SEQ ID NO: 4867 - protein, 56 aa, Aichivirus A
ATTQQSLIVPTAEVRPGVNVNRMSRLHPSPAYGAFPIKKQPAPLRRNDRRLQEGVD

SEQ ID NO: 4868 - protein, 56 aa, Aichivirus A
GQAAGYPWNTLGRSRRSLFDETEPGVFVPKPELQAEINQTLEDPDYVYSTFLKDEL

SEQ ID NO: 4869 - protein, 56 aa, Hepatitis C virus
MSTLPKPQRKTKRNTNRRPMDVKFPGGGQIVGGVYLLPRKGPRLGVRATRKTSERS

SEQ ID NO: 4870 - protein, 56 aa, Hepatitis C virus
MSTNPKPQRKTKRNTNRRPQDVKFPGGGQIVGGVYLLPRRGPRLGVRATRKASERS

SEQ ID NO: 4871 - protein, 56 aa, Hepatitis C virus
MSTNPKPQRKTKRNTNRRPEDVKFPGGGQIVGGVYLLPRRGPRLGVRTTRKTSERS

SEQ ID NO: 4872 - protein, 56 aa, Hepatitis C virus
MSTNPKPQRKTKRNTYRRPQDVKFPGGGQIVGGVYVLPRRGPTLGVRATRKTSERS

SEQ ID NO: 4873 - protein, 56 aa, Hepatitis C virus
MSTLPKPQRKTKRNTNRRPMDVKFPGGGQIVGGVYLLPRRGPRLGVRATRKTSERS

SEQ ID NO: 4874 - protein, 56 aa, Hepatitis C virus
MSTNPKPQRKTKRNTNRRPQDVKFPGGGQIVGGVYLLPRRGPRVGVRATRKTSERS

SEQ ID NO: 4875 - protein, 56 aa, Hepatitis C virus
MSTNPKPQRKTKRNTNRRPQDVKFPGGGQIVGGVYLLPRRGPRLGVRATRKTSERS

SEQ ID NO: 4876 - protein, 56 aa, Hepatitis C virus
MSTNPKPQRKTKRNTNRRPQDVKFPGGGQIVGGVYLLPRRGPKLGVRATRKNSERS

SEQ ID NO: 4877 - protein, 56 aa, Hepatitis C virus; identical to SEQ ID NO: 4873

SEQ ID NO: 4878 - protein, 56 aa, Hepatitis C virus; identical to SEQ ID NO: 4875

SEQ ID NO: 4879 - protein, 56 aa, Hepatitis C virus
MSTIPKPQRKTKRNTNRRPQDVKFPGGGQIVGGVYLLPRRGPRLGVRATRKTSERS

SEQ ID NO: 4880 - protein, 56 aa, Hepatitis C virus; identical to SEQ ID NO: 4875

SEQ ID NO: 4881 - protein, 56 aa, Hepatitis C virus
MSTNPKPQRKTKRNTNRRPQDVKFPGGGQIVGGVYLLPRRGPRLGVRAARKTSERS

SEQ ID NO: 4882 - protein, 56 aa, Hepatitis C virus; identical to SEQ ID NO: 4875

SEQ ID NO: 4883 - protein, 56 aa, Hepatitis C virus
MSTNPKPQRKTKRNTNRRPQDVKFPGGGQIVGGVYLLPRRGPRLGVRAPRKTSERS

SEQ ID NO: 4884 - protein, 56 aa, Hepatitis C virus
MSTNPKPQKKNKRNTNRRPQDVKFPGGGQIVGGVYLLPRRGPRLGVRATRKTSERS

SEQ ID NO: 4885 - protein, 56 aa, Hepatitis C virus
MSTNPKPQRQTKRNTNRRPQDVKFPGGGQIVGGVYLLPRRGPRLGVRATRKTSERS

SEQ ID NO: 4886 - protein, 56 aa, Hepatitis C virus
MSTNPKPQRKTKRNTNRRPMDVKFPGGGQIVGGVYLLPRRGPRLGVRATRKTSERS

SEQ ID NO: 4887 - protein, 56 aa, Hepatitis C virus
MSTNGKPQRKTKRNTNRRPQDVKFPGGGQIVGGVYLLPRRGPRLGVRATRKTWERS

SEQ ID NO: 4888 - protein, 56 aa, Hepatitis C virus
MSTLPKPQKRNQRNTNRRPQDVKFPGGGQIVGGVYLLPRRGPRLGVRATRKTSERS

SEQ ID NO: 4889 - protein, 56 aa, Hepatitis C virus; identical to SEQ ID NO: 4873

SEQ ID NO: 4890 - protein, 56 aa, Hepatitis C virus; identical to SEQ ID NO: 4875

SEQ ID NO: 4891 - protein, 56 aa, Hepatitis C virus; identical to SEQ ID NO: 4875

SEQ ID NO: 4892 - protein, 56 aa, Hepatitis C virus
MSTLPKPQRKTKRNTIRRPQDVKFPGGGQIVGGVYVLPRRGPRLGVRATRKTSERS

SEQ ID NO: 4893 - protein, 56 aa, Hepatitis C virus
QIVGGVYLLPRRGPRLGVRATRKTSERSQPRGRRQPIPKARRPEGRSWAQPGYPWP

SEQ ID NO: 4894 - protein, 56 aa, Hepatitis C virus
QPRGRRQPIPKARQPEGRAWAQPGYPWPLYGNEGLGWAGWLLSPRGSRPSWGPTDP

SEQ ID NO: 4895 - protein, 56 aa, Hepatitis C virus
QPRGRRQPIPKARRPEGRSWAQPGYPWPLYGNEGCGWAGWLLSPRGSRPSWGPSDP

SEQ ID NO: 4896 - protein, 56 aa, Hepatitis C virus
QIVGGVYLLPRRGPRLGVRATRKASERSQPRGRRQPIPKARRPEGRAWAQPGYPWP

SEQ ID NO: 4897 - protein, 56 aa, Hepatitis C virus
TDDVEPSVAAECFKKPPKYPPALPIWARPDYNPPLLDRWKAPDYVPPTVHGCALPP

SEQ ID NO: 4898 - protein, 56 aa, Hepatitis C virus
QIVGEVYVLPRRGPQLGVREVRKTSERSQPRGRRQPTPKARPREGRSWAQPGYPWP

SEQ ID NO: 4899 - protein, 56 aa, Hepatitis C virus
MSTLPKPKRQTKRNTLRRPKNVKFPAGGQIVGEVYVLPRRGPQLGVREVRKTSERS

SEQ ID NO: 4900 - protein, 56 aa, Hepatitis C virus
QIVGGVYLLPRRGPRLGVRATRKTSERSQPRGRRQPIPKARQPIGRSWGQPGYPWP

SEQ ID NO: 4901 - protein, 56 aa, Hepatitis C virus
QPRGRRQPIPKARRPEGRSWAQPGYPWPLYGNEGCGWAGWLLSPRGSRPSWGPNDP

SEQ ID NO: 4902 - protein, 56 aa, Hepatitis C virus
SVPSEYLTRRRKFPPALPPWARPDYNPPVIETWKRPDYEPPTVLGCALPPTPQAPV

SEQ ID NO: 4903 - protein, 56 aa, Hepatitis C virus
SVPAEILRKPRKFPPALPIWARPDYNPPLLESWKDPDYVPPVVHGCPLPSTKAPPI

SEQ ID NO: 4904 - protein, 56 aa, Hepatitis C virus
TDDAELSAAAECFKKPPKYPPALPIWARPDYNPPLLDRWKSPDYVPPTVHGCALPP

SEQ ID NO: 4905 - protein, 56 aa, Hepatitis C virus
MSTLPKPQRITKRNINRRPQDVKFPGGGQIVGGVYVLPRRGPKLGVRAVRKTSERS

SEQ ID NO: 4906 - protein, 56 aa, Hepatitis C virus
QIVGGVYLLPRRGPRVGVRATRKTSERSQPRGRRQPIPKARRPEGRSWAQPGYPWP

SEQ ID NO: 4907 - protein, 56 aa, Hepatitis C virus
QIVGGVYLLPRRGPRLGVRATRKTSERSQPRGRRQPIPKDRRSTGKSWGKPGYPWP

SEQ ID NO: 4908 - protein, 56 aa, Hepatitis C virus
SVAAEILRKTKRFPPAMPIWARPDYNPPLLESWKDPDYVPPVVHGCPLPPTKAPPI

SEQ ID NO: 4909 - protein, 56 aa, Hepatitis C virus
MSTNPKPQRKTKRNTNRRPQNVKFPGGGQIVGGVCLLPRRGPRVGVRATRKTSERS

SEQ ID NO: 4910 - protein, 56 aa, Hepatitis C virus
ATCTTHHDSPDVDLIEANLLWRQEMGGNITRVESENKVVILDSFDPLRAEEDEREP

SEQ ID NO: 4911 - protein, 56 aa, Hepatitis C virus
QPRGRRQPIPKARQPEGRAWAQPGYPWPLYGNEGMGWAGWLLSPRGSRPSWGPTDP

SEQ ID NO: 4912 - protein, 56 aa, Hepatitis C virus
SVPAEILRKSRKFPPALPVWARPDYNPPLLEPWKDPDYVPPVVHGCPLPPVKAPPI

SEQ ID NO: 4913 - protein, 56 aa, Hepatitis C virus
TAKRRLARGSPPSLASSSASQLSAPSLKATCTTHHVSPDADLIEANLLWRQEMGGN

SEQ ID NO: 4914 - protein, 56 aa, Hepatitis C virus
ATCTTHHVSPDADLIEANLLWRQEMGGNITRVESENKVVVLDSFDPLRAEEDEREV

SEQ ID NO: 4915 - protein, 56 aa, Hepatitis C virus
ATCTANHDSPDAELIEANLLWRQEMGGNITRVESENKVVILDSFDPLVAEEDEREI

SEQ ID NO: 4916 - protein, 56 aa, Hepatitis C virus
SVPAEILRKSRRFAQALPVWARPDYNPPLVETWKKPDYEPPVVHGCPLPPPKSPPV

SEQ ID NO: 4917 - protein, 56 aa, Hepatitis C virus
QPRGRRQPIPKARQPEGRAWAQPGYPWPLYGNEGLGWAGWLVSPRGSRPNWGPTDP

SEQ ID NO: 4918 - protein, 56 aa, Hepatitis C virus
ITRVESENKVVILDSFDPLRAEEDEREVSVPAEILRKSRKFPPALPVWARPDYNPP

SEQ ID NO: 4919 - protein, 56 aa, Hepatitis C virus
QPRGRRQPIPKARRSEGRSWAQPGYPWPLYGNEGCGWAGWLLSPRGSRPSWGPNDP

SEQ ID NO: 4920 - protein, 56 aa, Hepatitis C virus
KATCTMHGAHPDAELIEANLLWRQEMGGNITRVESENKVVILDSFDPLVPEFEERE

SEQ ID NO: 4921 - protein, 56 aa, Hepatitis C virus
ITRVESENKIVVLDSFDPLVAEEDDREISIPAEILRKFKQFPPAMPIWARPDYNPP

SEQ ID NO: 4922 - protein, 56 aa, Hepatitis C virus
SIPAEILRKFKQFPPAMPIWARPDYNPPLVEPWKRPDYEPPLVHGCPLPPPKPTPV

SEQ ID NO: 4923 - protein, 56 aa, Hepatitis C virus
ATCTTHHDSPDADLIEANLLWRQEMGGNITRVESENKIVVLDSFDPLVAEEDDREI

SEQ ID NO: 4924 - protein, 56 aa, Hepatitis C virus
TAARRLKRGSPPSLASSSASQLSAPSLKATCTTHHDSPDADLIEANLLWRQEMGGN

SEQ ID NO: 4925 - protein, 56 aa, Hepatitis C virus
ITRVESENKVVILDSFDPLRAEEDEREVSVAAEILRKSKKFPPALPIWARPDYNPP

SEQ ID NO: 4926 - protein, 56 aa, Hepatitis C virus
LKATCTTHCAHPDADLIEANLLWRQEVGGNITRVESENKVIVLDSFDPLVPEYDDR

SEQ ID NO: 4927 - protein, 56 aa, Hepatitis C virus
AEEDDTELSIPAECFKKPPKYPPALPIWARPDYNPPLLPSWKDPTYEPPAVHGCAL

SEQ ID NO: 4928 - protein, 56 aa, Hepatitis C virus
APSLKATCTTSKDHPDMELIEANLLWRQEMGGNITRVESENKVVVLDSFEPLTAEY

SEQ ID NO: 4929 - protein, 56 aa, Hepatitis C virus
ITRVESENKVVILDSFDPLVAEEDEREVSVPAEILRKSRRFAPALPVWARPDYNPL

SEQ ID NO: 4930 - protein, 56 aa, Hepatitis C virus
ITRVESENKVVILDSFDPLVAEEDEREISVPAEILRKSRRFAQALPVWARPDYNPP

SEQ ID NO: 4931 - protein, 56 aa, Hepatitis C virus; identical to SEQ ID NO: 4907

SEQ ID NO: 4932 - protein, 56 aa, Hepatitis C virus
TAKRRLARGSPPSLASSSASQLSAPSLKATCTTHHDSPDVDLIEANLLWRQEMGGN

SEQ ID NO: 4933 - protein, 56 aa, Hepatitis C virus
QIVGGVYLLPRRGPRLGVRATRKTSERSQPRGRRQPIPKARRPEGRAWAQPGYPWP

SEQ ID NO: 4934 - protein, 56 aa, Hepatitis C virus
SVPAEILRKSRRFTQALPIWARPDYNPPLIETWKKPNYEPPVVHGCPLPPPQSPPV

SEQ ID NO: 4935 - protein, 56 aa, Hepatitis C virus
ATCTTRHDSPDADLIEANLLWRQEMGGNITRVESENKVVILDSFEPLQAEEDEREV

SEQ ID NO: 4936 - protein, 56 aa, Hepatitis C virus
ITRVESENKIVILDSFDPLVAEEDDREISVPAEILLKSKKFPPAMPIWARPDYNPP

SEQ ID NO: 4937 - protein, 56 aa, Hepatitis C virus
SIPSEYMLPKKRFPPALPAWARPDYNPPLVESWKRPDYQPATVAGCALPPPKKTPT

SEQ ID NO: 4938 - protein, 56 aa, Hepatitis C virus
ATCTTHHDSPDADLITANLLWRQEMGGNITRVESENKIVILDSFDPLVAEEDDREI

SEQ ID NO: 4939 - protein, 56 aa, Hepatitis C virus
VIVGRIILSGKPAVVPDREVLYQEFDEMEECASHLPYIEQGMQLAEQFKQKALGLL

SEQ ID NO: 4940 - protein, 56 aa, Hepatitis C virus
QIVGGVYLLPRRGPRLGVRTTRKTSERSQPRGRRQPIPKDRRSTGKAWGKPGRPWP

SEQ ID NO: 4941 - protein, 56 aa, Hepatitis C virus
ITRVESENKVVILDSFDPLRAEEDEREPSVAAEILRKTKRFPPAMPIWARPDYNPP

SEQ ID NO: 4942 - protein, 56 aa, Hepatitis C virus
ATCTANHDSPDAELIEANLLWRQEMGGNITRVESENKVVILDSFDPLVAEEDEREV

SEQ ID NO: 4943 - protein, 56 aa, Hepatitis C virus
SVPAEILLKSKKFPPAMPIWARPDYNPPLVEPWKRPDYEPPLVHGCPLPPPKPTPV

SEQ ID NO: 4944 - protein, 56 aa, Hepatitis C virus
SVPAEILRKSRRFAPALPVWARPDYNPLLVETWKKPDYEPPVVHGCPLPPPRSPPV

SEQ ID NO: 4945 - protein, 56 aa, Hepatitis C virus
QIVGGVYLLPRRGPRLGVRATRKTSERSQPRGRRQPIPKARRPEGRTWAQPGYPWP

SEQ ID NO: 4946 - protein, 56 aa, Hepatitis C virus
SIPSECMLPRSGFPRALPAWARPDYNPPLVESWRRPDYQPPTVAGCALPPPKKAPT

SEQ ID NO: 4947 - protein, 56 aa, Hepatitis C virus
DEDELSVAAECFKKPPKYPPALPIWARPDYNPPLVEPWKDPDYVPPTVHGCALPPQ

SEQ ID NO: 4948 - protein, 56 aa, Hepatitis C virus
GSQLPCEPEPDVAVLTSMLTDPSHITAESARRRLARGSRPSLASSSASQLSPRLLQ

SEQ ID NO: 4949 - protein, 56 aa, Hepatitis C virus
CTTAGKHPDAELIEANLLWRQEVGGNITRVESENKIIVLDSFDPLIAETDDREISV

SEQ ID NO: 4950 - protein, 56 aa, Hepatitis C virus
ITRVESENKVVILDSFDPIRAVEDEREISVPAEILRKPRKFPPALPIWARPDYNPP

SEQ ID NO: 4951 - protein, 56 aa, Hepatitis C virus
QPRGRRQPIPKVRRPEGRTWAQPGYPWPLYGNEGCGWAGWLLSPRGSRPSWGPTDP

SEQ ID NO: 4952 - protein, 56 aa, Hepatitis C virus
ATCTINHDSPDAELIEANLLWRQEMGGNITRVESENKVVILDSFDPLVAEEDEREI

SEQ ID NO: 4953 - protein, 56 aa, Hepatitis C virus
TAKRRLARGSPPSLASSSASQLSALSLKAACTTRHTPPDADLIEANLLWRQEMGGN

SEQ ID NO: 4954 - protein, 56 aa, Hepatitis C virus
SVAAEILRKSRKFPSALPIWARPDYNPPLLESWKDPDYVPPVVHGCPLPPTKAPPI

SEQ ID NO: 4955 - protein, 56 aa, Hepatitis C virus
VTRIESDSKVIVLDSLDSMTEVEDDREPSVPSEYLIKRRKFPPALPPWARPDYNPV

SEQ ID NO: 4956 - protein, 56 aa, Hepatitis C virus
QIVGGVYLLPRRGPRLGVRATRKTSERSQPRGRRQPIPKVRRPEGRTWAQPGYPWP

SEQ ID NO: 4957 - protein, 56 aa, Hepatitis C virus
TAARRLNRGSPPSLASSSASQLSAPSLKATCTTHHDSPDADLITANLLWRQEMGGN

SEQ ID NO: 4958 - protein, 56 aa, Hepatitis C virus
ITRVESENKVVILDSFDPLVAEEDEREISVPAEILRKSRRFTQALPIWARPDYNPP

SEQ ID NO: 4959 - protein, 56 aa, Hepatitis C virus
TAKRRLARGSPPSLASSSASQLSAPSLKATCTTRHDSPDADLIEANLLWRQEMGGN

SEQ ID NO: 4960 - protein, 56 aa, Hepatitis C virus
ITRVESENKVVVLDSFDPLRAEEDEREVSVPAEILRKSKKFPAAMPIWARPDYNPP

SEQ ID NO: 4961 - protein, 56 aa, Hepatitis C virus
QPRGRRQPTPKARPREGRSWAQPGYPWPLYGNEGCGWAGWLLPPRGSRPSWGQNDP

SEQ ID NO: 4962 - protein, 56 aa, Hepatitis C virus
ITRVESENKVVILDSFEPLHAEGDEREISVAAEILRKSRKFPSALPIWARPDYNPP

SEQ ID NO: 4963 - protein, 56 aa, Hepatitis C virus
VDATTYTTGGNAARTTQALTSFFSPGAKQDIQLINTNGSWHINRTALNCNASLDTG

SEQ ID NO: 4964 - protein, 56 aa, Hepatitis C virus
QPRGRRQPIPKARPSQGRTWGQPGYPWPLYGNEGCGWAGWLMSPRGSRPSWGPNDP

SEQ ID NO: 4965 - protein, 56 aa, Hepatitis C virus
PSLKATCTTHADHPDAELVEANLLWRQEMGGNITRVESENKIVILDSFEPLKAEFD

SEQ ID NO: 4966 - protein, 56 aa, Hepatitis C virus
QPRGRRQPIPKARRPEGRTWAQPGYPWPLYGNEGCGWAGWLLSPRGSRPSWGPTDP

SEQ ID NO: 4967 - protein, 56 aa, Hepatitis C virus
QIVGGVYLLPRRGPRLGVRATRKTSERSQPRGRRQPIPKARQPTGRSWGQPGYPWP

SEQ ID NO: 4968 - protein, 56 aa, Hepatitis C virus
QLSAPSLKATCQTHRPHPDAELIDANLLWRQEMGSNITRVESETKVVILDSFEPLR

SEQ ID NO: 4969 - protein, 56 aa, Hepatitis C virus
LLEPWKDPDYVPPVVHGCPLPPVKAPPIPPPRRKRTVVLTESTVSSALAELATKTF

SEQ ID NO: 4970 - protein, 56 aa, Hepatitis C virus
QIVGGVYVLPRRGPRLGVRATRKTSERSQPRGRRQPIPKARRSEGRSWAQPGYPWP

SEQ ID NO: 4971 - protein, 56 aa, Hepatitis C virus
LNSYAIGSQLPCEPEPDVSVLTSMLRDPSHITAETAARRLARGSPPSEASSSASQL

SEQ ID NO: 4972 - protein, 56 aa, Hepatitis C virus
SVPSEYLLPKKKFPQALPVWARPDYNPPVVETWKRPDYDPPTVSGCALPPRVTAPT

SEQ ID NO: 4973 - protein, 56 aa, Hepatitis C virus
KATCTIQGHHPDADLIKANLLWRQCMGGNITRVEAENKVEILDCFKPLKEEEDDRE

SEQ ID NO: 4974 - protein, 56 aa, Hepatitis C virus
RVESENKIIVLDSFDPLIAETDDREISVGAECFNPPRPKFPPALPVWARPDYNPPL

SEQ ID NO: 4975 - protein, 56 aa, Hepatitis C virus
DDREISVSAECHRPPRPKFPPALPIWARPDYNPPLLQKWQMPGYEPPVVSGCALPP

SEQ ID NO: 4976 - protein, 56 aa, Hepatitis C virus
ETAKRRLDRGSPPSLASSSASQLSAPSLKATCTTQGHHPDADLIEANLLWRQCMGG

SEQ ID NO: 4977 - protein, 56 aa, Hepatitis C virus
SAPSLKATCQTHRPHPDAELVDANLLWRQEMGSNITRVESETKVVVLDSFEPLRAE

SEQ ID NO: 4978 - protein, 56 aa, Hepatitis C virus
AACTTRHTPPDADLIEANLLWRQEMGGNITRVESENKVVILDSFDPLRAEEDEREV

SEQ ID NO: 4979 - protein, 56 aa, Hepatitis C virus
VIVGRIILSGKPAVVPDREVLYQEFDEMEECASQLPYIEQGMQLAEQFKQKALGLL

SEQ ID NO: 4980 - protein, 56 aa, Hepatitis C virus
QPRGRRQPIPKARRQTGRTWAQPGYPWPLYGNEGCGWMGWLLSPRGSRPHWGPNDP

SEQ ID NO: 4981 - protein, 56 aa, Hepatitis C virus; identical to SEQ ID NO: 4907

SEQ ID NO: 4982 - protein, 56 aa, Hepatitis C virus
EAAARRLARGSPPSLASSSASQLSAPSLKATCTMHGAHPDAELIEANLLWRQEMGG

SEQ ID NO: 4983 - protein, 56 aa, Hepatitis C virus
VIVGRIILSGRPAVIPDREVLYREFDEMEECASHLPYIEQGMQLAEQFKQKALGLL

SEQ ID NO: 4984 - protein, 56 aa, Hepatitis C virus
LHSYTIGSQLPCEPEPDVSVLTSMLRDPSHITAETAARRLARGSPPSEASSSASQL

SEQ ID NO: 4985 - protein, 56 aa, Hepatitis C virus
TAASEAGSLSSMPPLEGEPGDPDLEFEPVGSAPPSEGECEVIDSDSKSWSTVSDQE

SEQ ID NO: 4986 - protein, 56 aa, Hepatitis C virus
KATCTTQGHHPDADLIEANLLWRQCMGGNITRVEAENKVVILDSFEPLKADDDDRE

SEQ ID NO: 4987 - protein, 56 aa, Hepatitis C virus
EPSVPAECHRPNRPKFPPALPIWARPDYNPPLLETWKKPDYAPPLVHGCALPSPVQ

SEQ ID NO: 4988 - protein, 56 aa, Hepatitis C virus
QPRGRRQPIPKARRPEGRTWAQPGYPWPLYGNEGLGWAGWLLSPRGSRPSWGPTDP

SEQ ID NO: 4989 - protein, 56 aa, Hepatitis C virus
NPPLLETWKKPDYAPPLVHGCALPSPVQPPVPPPRRKSVVHLDDSTVATALAELAE

SEQ ID NO: 4990 - protein, 56 aa, Hepatitis C virus
VTRIESDSKVIVLDSLDSMTEVEDDREPSVPSEYLTRRRKFPPALPPWARPDYNPP

SEQ ID NO: 4991 - protein, 56 aa, Hepatitis C virus; identical to SEQ ID NO: 4907

SEQ ID NO: 4992 - protein, 56 aa, Hepatitis C virus
SVPAEILRKSKKFPAAMPIWARPDYNPPLLESWKDPDYVPPVVHGCPLPPIKAPPI

SEQ ID NO: 4993 - protein, 56 aa, Hepatitis C virus
ISVSADCFKKGPAFPPALPVWARPGYDPPLLETWKRPDYDPPQVWGCPIPPAGPPP

SEQ ID NO: 4994 - protein, 56 aa, Hepatitis C virus
EMGSNITRVESESKVVILDSFEPLRACDDEDELSVAAECFKKPPKYPPALPIWARP

SEQ ID NO: 4995 - protein, 56 aa, Hepatitis C virus
NITRVEAENKVEILDCFKPLKEEEDDREISVSADCFKKGPAFPPALPVWARPGYDP

SEQ ID NO: 4996 - protein, 56 aa, Hepatitis C virus
VIVGRVVLSGKPAIIPDREVLYREFDEMEECSQHLPYIEQGMMLAEQFKQKALGLL

SEQ ID NO: 4997 - protein, 56 aa, Hepatitis C virus
RLHRYAPACKPLLREEVTFQVGLNQYLVGSQLPCEPEPDVAVLTSMLTDPSHITAE

SEQ ID NO: 4998 - protein, 56 aa, Hepatitis C virus
RIHRHAPKCKPLLRDEVSFSVGLNSFVVGSQLPCEPEPDVAVLTSMLTDPSHITAE

SEQ ID NO: 4999 - protein, 56 aa, Hepatitis C virus
QPRGRRQPIPKARRPTGRSWGQPGYPWPLYANEGLGWAGWLLSPRSSRPNWGPNDP

SEQ ID NO: 5000 - protein, 56 aa, Hepatitis C virus
LVEPWKRPDYEPPLVHGCPLPPPKPTPVPPPRRKRTVVLDESTVSSALAELATKTF

SEQ ID NO: 5001 - protein, 56 aa, Hepatitis C virus
VIVGRIILGGKPAVIPDREVLYREFDEMEECAAHVPYLEQGMHLAGQFKQKALGLL

SEQ ID NO: 5002 - protein, 56 aa, Hepatitis C virus
VTRIESESKVVVLDSLDPMVEERSDLEPSIPSEYMLPKKRFPPALPAWARPDYNPP

SEQ ID NO: 5003 - protein, 56 aa, Hepatitis C virus
MSVPAECHRPRRPKFPPALPIWATPGYNPPVLETWKSPTYEPPVVHGCALPPSGPP

SEQ ID NO: 5004 - protein, 56 aa, Hepatitis C virus
NITRVEAENKVVILDSFEPLKADDDDREISVSADCFRRGPAFPPALPIWARPGYDP

SEQ ID NO: 5005 - protein, 56 aa, Hepatitis C virus
QPRGRRQPIPKARRPEGRAWAQPGYPWPLYGNEGLGWAGWLLSPRGSRPSWGPTDP

SEQ ID NO: 5006 - protein, 56 aa, Hepatitis C virus
SFVVGSQLPCDPEPDTDVLTSMLTDPSHITAETAARRLARGSPPSEASSSASQLSA

SEQ ID NO: 5007 - protein, 56 aa, Hepatitis C virus
LLESWKDPDYVPPVVHGCPLPPAKAPPIPPPRRKRTVVLSESTVSSALAELATKTF

SEQ ID NO: 5008 - protein, 56 aa, Hepatitis C virus
PPDEPDDSEAGSVSSMPPLEGEPGDPDLEPEQVEHPAPPQEGGAAPGSDSGSWSTC

SEQ ID NO: 5009 - protein, 56 aa, Hepatitis C virus
SAPSLKATCQTHRPHPDAELVDANLLWRQEMGSNITRVESETKVVILDSFEPLRAE

SEQ ID NO: 5010 - protein, 56 aa, Hepatitis C virus
QPRGRRQPIPKDRRSTGKAWGKPGRPWPLYGNEGLGWAGWLLSPRGSRPSWGPTDP

SEQ ID NO: 5011 - protein, 56 aa, Hepatitis C virus
QPRGRRQPIPKDRRSTGKSWGRPGYPWPLYRNEGLGWAGWLLSPRGSRPSWGPSDP

SEQ ID NO: 5012 - protein, 56 aa, Hepatitis C virus
QIVGGVYLLPRRGPRLGVRAARKTSERSQPRGRRQPIPKDRRSTGKSWGRPGYPWP

SEQ ID NO: 5013 - protein, 56 aa, Hepatitis C virus
QEMGSNITRVESETKVVVLDSFEPLRAETDDVEPSVAAECFKKPPKYPPALPIWAR

SEQ ID NO: 5014 - protein, 56 aa, Hepatitis C virus
ITRVESENKVVILDSFEPLQAEEDEREVSVPAEILRRSRKFPRAMPIWARPDYNPP

SEQ ID NO: 5015 - protein, 56 aa, Hepatitis C virus
LQPWKAPDYEPPLVHGCALPPKGLPPVPPPRKKRVVQLDEGSAKRALAELAQTSFP

SEQ ID NO: 5016 - protein, 56 aa, Hepatitis C virus
EPSSDRDTDLTTPTETTDSGPIVVDDASDDGSYSSMPPLEGEPGDPDLTSDSWSTV

SEQ ID NO: 5017 - protein, 56 aa, Hepatitis C virus
ICAAVLRRHVGPGEGAVQWMNRLIAFASRGNHVSPTHYVPESDAAAKVTALLSSLT

SEQ ID NO: 5018 - protein, 56 aa, Hepatitis C virus
YPGAITGHRMAWDMMMNWSPTATMILAYAMRVPEVIIDIISGAHWGVMFGLAYFSM

SEQ ID NO: 5019 - protein, 56 aa, Hepatitis C virus
QPRGRRQPIPKARQPQGRHWAQPGYPWPLYGNEGCGWAGWLLSPRGSRPHWGPNDP

SEQ ID NO: 5020 - protein, 56 aa, Hepatitis C virus
SKVLPSPGEESDSESCSSMPPLEGEPGDPDLSCDSWSTVSDSEEQSVVCCSMSYSW

SEQ ID NO: 5021 - protein, 56 aa, Hepatitis C virus
NITRVESENKVVILDSFDPLVPEFEEREMSVPAECHRPRRPKFPPALPIWATPGYN

SEQ ID NO: 5022 - protein, 56 aa, Hepatitis C virus
QPRGRRQPIPKARRPKGRNWAQPGYPWPLYGNEGCGWAGWLPSPRGSRPSWGPNDP

SEQ ID NO: 5023 - protein, 56 aa, Hepatitis C virus
EAESYSSMPPLEGEPGDPDLSDGSWSTVSSDGGTEDVVCCSMSYSWTGALITPCAA

SEQ ID NO: 5024 - protein, 56 aa, Hepatitis C virus
GNITRVESENKVIVLDSFDPLVPEYDDREPSVPAECHRPNRPKFPPALPIWARPDY

SEQ ID NO: 5025 - protein, 56 aa, Hepatitis C virus
QPRGRRQPIPKDRRSTGKSWGKPGYPWPLYGNEGLGWAGWLLSPRGSRPSWGPNDP

SEQ ID NO: 5026 - protein, 56 aa, Hepatitis C virus
KRDDDSDAASYSSMPPLEGEPGDPDLSSGSWSTVSDEDSVVCCSMSYSWTGALITP

SEQ ID NO: 5027 - protein, 56 aa, Hepatitis C virus; identical to SEQ ID NO: 5025

SEQ ID NO: 5028 - protein, 56 aa, Hepatitis C virus
DVESYSSMPPLEGEPGDPDLSDGSWSTVSGEAGEDVVCCSMSYTWTGALITPCAAE

SEQ ID NO: 5029 - protein, 56 aa, Hepatitis C virus
EMGGNITRVESENKVVVLDSFEPLTAEYDEREISVSAECHRPPRHKFPPALPIWAR

SEQ ID NO: 5030 - protein, 56 aa, Hepatitis C virus
RLHRYAPACKPLLREEVSFQVGLNQYVVGSQLPCEPEPDVAVLTSMLTDPSHITAE

SEQ ID NO: 5031 - protein, 56 aa, Hepatitis C virus
GSQLPCEPEPDVTVLTSMLTDPSHITAETAKRRLARGSPPSLASSSASQLSAPSLK

SEQ ID NO: 5032 - protein, 56 aa, Hepatitis C virus
DREISVAAECHRPPRFKYPPALPVWARPDYNPPLLETWKAPDYDPPVVSGCALPPQ

SEQ ID NO: 5033 - protein, 56 aa, Hepatitis C virus
EECAAHVPYLEQGMHLAGQFKQKALGLLQTASKQAETITPTVRTNWQKLESFWAKH

SEQ ID NO: 5034 - protein, 56 aa, Hepatitis C virus
QPRGRRQPIPKARQPIGRSWGQPGYPWPLYGNEGCGWAGWLLSPRGSRPNWGPNDP

SEQ ID NO: 5035 - protein, 56 aa, Hepatitis C virus
RLHRFAPPCKPLLREEVSFRVGLHDYPVGSQLPCEPEPDVAVLTSMLTDPSHITAA

SEQ ID NO: 5036 - protein, 56 aa, Hepatitis C virus
AESGDSPETGEESDVESYSSMPPLEGEPGDPDLDADSWSTVSDSEEQSVVCCSMSY

SEQ ID NO: 5037 - protein, 56 aa, Hepatitis C virus
QIVGGVYLLPRRGPRLGVRATRKTSERSQPRGRRQPIPKARQPEGRAWAQPGYPWP

SEQ ID NO: 5038 - protein, 56 aa, Hepatitis C virus
SVPSEYLIKRRKFPPALPPWARPDYNPVLIETWKRPGYEPPTVLGCALPPTPQTPV

SEQ ID NO: 5039 - protein, 56 aa, Hepatitis C virus
ETAKRRLNRGSPPSLANSSASQLSAPSLKATCTIQGHHPDADLIKANLLWRQCMGG

SEQ ID NO: 5040 - protein, 56 aa, Hepatitis C virus
PLLETWKRPDYDPPQVWGCPIPPAGPPPVPLPRRKRKPMELSDSTVSQVMADLADA

SEQ ID NO: 5041 - protein, 56 aa, Hepatitis C virus
APSLKATCTANGDHPDAELIEANLLWRQEMGSNITRVESETKVVILDSFDPLVAEY

SEQ ID NO: 5042 - protein, 56 aa, Hepatitis C virus
VIVGRIVLSGKPAIIPDREVLYQEFDEMEECSQHLPYIEQGMMLAEQFKQKALGLL

SEQ ID NO: 5043 - protein, 56 aa, Hepatitis C virus
LLESWKDPDYVPPVVHGCPLPSTKAPPIPPPRRKRTVVLTESTVSSALAELATKTF

SEQ ID NO: 5044 - protein, 56 aa, Hepatitis C virus
RLHRYAPPCKPLLREEVTFSIGLNEYLVGSQLPCEPEPDVAVLTSMLTDPSHITAE

SEQ ID NO: 5045 - protein, 56 aa, Hepatitis C virus
GSSTTSGVTSGEAAESSPAPSCDGELDSEAESYSSMPPLEGEPGDPDLSDGSWSTV

SEQ ID NO: 5046 - protein, 56 aa, Hepatitis C virus
QPRGRRQPIPKARRQTGRAWGQPGYAWPLYGNEGCGWAGWLLSPRGSRPTWGPNDP

SEQ ID NO: 5047 - protein, 56 aa, Hepatitis C virus
RLHRYAPACKPLLREDVTFQVGLNQYLVGSQLPCEPEPDVTVLTSMLTDPSHITAE

SEQ ID NO: 5048 - protein, 56 aa, Hepatitis C virus
SNYAIGSQLPCEPEPDVTVVTSMLTDPTHITAETASRRLKRGSPPSLASSSASQLS

SEQ ID NO: 5049 - protein, 56 aa, Hepatitis C virus
EREPSIPSEYLLPKSRFPPALPPWARPDYNPPLLETWKRPDYQPPVVAGCALPPPG

SEQ ID NO: 5050 - protein, 56 aa, Hepatitis C virus
QIVGGVYVLPRRGPTLGVRATRKTSERSQPRGRRQPIPKARRPEGRAWAQPGYPWP

SEQ ID NO: 5051 - protein, 56 aa, Hepatitis C virus
EECASHLPYIEQGMQLAEQFKQKALGLLQTATKQAEAAAPVVESKWRTLEAFWAND

SEQ ID NO: 5052 - protein, 56 aa, Hepatitis C virus
AAGRRLARGSPPSMASSSASQLSAPSLKATCTANHDSPDAELIEANLLWRQEMGGN

SEQ ID NO: 5053 - protein, 56 aa, Hepatitis C virus
DVESYSSMPPLEGEPGDPDLSDGSWSTVSEEASEDVVCCSMSYTWTGALITPCAAE

SEQ ID NO: 5054 - protein, 56 aa, Hepatitis C virus
SLVVGSQLPCDPEPDTEVLASMLTDPSHITAETAARRLARGSPPSQASSSASQLSA

SEQ ID NO: 5055 - protein, 56 aa, Hepatitis C virus
PSTATLSEDSGRETSTLSSDMTPPREEADRASDDGSYSSMPPLEGEPGDPDLSSGS

SEQ ID NO: 5056 - protein, 56 aa, Hepatitis C virus
SPLQDNNDSGHSTGADTGGDIVQQPSDETAASEAGSLSSMPPLEGEPGDPDLEFEP

SEQ ID NO: 5057 - protein, 56 aa, Hepatitis C virus
DVESYSSMPPLEGEPGDPDLSDGSWSTVSSGADTEDVVCCSMSYSWTGALVTPCAA

SEQ ID NO: 5058 - protein, 56 aa, Hepatitis C virus
QPRGRRQPIPKDRRSAGKSWGRPGYPWPLYGNEGLGWAGWLLSPRGSRPSWGPTDP

SEQ ID NO: 5059 - protein, 56 aa, Hepatitis C virus
DAESYSSMPPLEGEPGDPDLSDGSWSTVSSEAGTEDVVCCSMSYTWTGALITPCAA

SEQ ID NO: 5060 - protein, 56 aa, Hepatitis C virus
VIVGRVVLSGQPAVIPDREVLYQQFDEMEECSKHLPLVEHGLQLAEQFKQKALGLL

SEQ ID NO: 5061 - protein, 56 aa, Hepatitis C virus
LLESWKDPDYVPPVVHGCPLPPTKAPPIPPPRRKRTVVLTESTVSSALAELATKTF

SEQ ID NO: 5062 - protein, 56 aa, Hepatitis C virus
PAPSETGSASSMPPLEGEPGDPDLESDQVELQPPPQGGGVAPGSGSGSWSTCSEED

SEQ ID NO: 5063 - protein, 56 aa, Hepatitis C virus
PSAEDDDASDADSYSSMPPLEGEPGDPDLSDGGGSGSWSTVSSEETSVVCCSMSYS

SEQ ID NO: 5064 - protein, 56 aa, Hepatitis C virus
SKVPPSPGGESDSESCSSMPPLEGEPGDPDLSCDSWSTVSDSEEQSVVCCSMSYSW

SEQ ID NO: 5065 - protein, 56 aa, Hepatitis C virus
MGGNITRVESENKIVILDSFEPLKAEFDDREISVAAECHRPPRFKYPPALPVWARP

SEQ ID NO: 5066 - protein, 56 aa, Hepatitis C virus
LVETWKKPDYEPPVVHGCPLPPPKSPPVPPPRKKRTVVLTESTLSTALAELATRSF

SEQ ID NO: 5067 - protein, 56 aa, Hepatitis C virus
HITAETASRRLKRGSPPSLASSSASQLSAPSLKATCTANGDHPDAELIEANLLWRQ

SEQ ID NO: 5068 - protein, 56 aa, Hepatitis C virus
EMGSNITRVESETKVVILDSFDPLVAEYDDREISVSAECHRPPRPKFPPALPIWAR

SEQ ID NO: 5069 - protein, 56 aa, Hepatitis C virus
APSRKATCTTHGRHPDAELITANLLWRQEMGSNITRVESESKVVILDSFEPLRACD

SEQ ID NO: 5070 - protein, 56 aa, Hepatitis C virus
SPLQDTNDSGHSTGADTGGDSVQQPSGETAASDAGSLSSMPPLEGEPGDPDLEFEP

SEQ ID NO: 5071 - protein, 56 aa, Hepatitis C virus
STDSEAGSDSSMPPLEGEPGDPDLESGSVEYHPSSQEGEAAPDLDSGSWSTCSEEG

SEQ ID NO: 5072 - protein, 56 aa, Hepatitis C virus
ISVSADCFRRGPAFPPALPIWARPGYDPPLLETWKQPDYDPPQVSGCPLPPAGLPP

SEQ ID NO: 5073 - protein, 56 aa, Hepatitis C virus
SFVVGSQLPCEPEPDTEVLASMLTDPSHITAEAAARRLARGSPPSEASSSASQLSA

SEQ ID NO: 5074 - protein, 56 aa, Hepatitis C virus
AAGRRLARGSPPSEASSSASQLSAPSLKATCTINHDSPDAELIEANLLWRQEMGGN

SEQ ID NO: 5075 - protein, 56 aa, Hepatitis C virus
SVPAEILRRSRKFPRAMPIWARPDYNPPLLESWKDPDYVPPVVHGCPLPPAKAPPI

SEQ ID NO: 5076 - protein, 56 aa, Hepatitis C virus
VIVGRIILSGKPAIIPDREVLYREFDEMEECASHLPYIEQGMQLAEQFKQKAIGLL

SEQ ID NO: 5077 - protein, 56 aa, Hepatitis C virus
HVSPTHYVPETDASKNVTQILTSLTITSLLRRLHQWVNEDTATPCATSWLRDVWDW

SEQ ID NO: 5078 - protein, 56 aa, Hepatitis C virus
LALSETGSISSMPPLEGEPGDPDLEPEQVELQPPPQGGVVTPGSGSGSWSTCSEED

SEQ ID NO: 5079 - protein, 56 aa, Hepatitis C virus
SYVVGSQLPCEPEPDTEVLASMLTDPSHITAEAAARRLARGSPPSAASSSASQLSA

SEQ ID NO: 5080 - protein, 56 aa, Hepatitis C virus
RLHRFAPPCKPLLREEVSFRVGLHEYPVGSQLPCEPEPDVAVLTSMLTDPSHITAE

SEQ ID NO: 5081 - protein, 56 aa, Hepatitis C virus
GSSESSAVDSGTATASPDQPSDDGDAGSDVESYSSMPPLEGEPGDPDLSDGSWSTV

SEQ ID NO: 5082 - protein, 56 aa, Hepatitis C virus
KRDDNSDAASYSSMPPLEGEPGDPDLSSGSWSTVSGEDNVVCCSMSYTWTGALITP

SEQ ID NO: 5083 - protein, 56 aa, Hepatitis C virus
RLHRYAPPCKPLLRDEVTFSIGLNEYLVGSQLPCEPEPDVAVLTSMLTDPSHITAE

SEQ ID NO: 5084 - protein, 56 aa, Hepatitis C virus
DYNPPLVEPWKDPDYVPPTVHGCALPPQKLPPVPPPRRKRTIVLSESTVSKALASL

SEQ ID NO: 5085 - protein, 56 aa, Hepatitis C virus
DEREISVSAECHRPPRHKFPPALPIWARPDYNPPLLQAWQMPGYEPPVVSGCAVAP

SEQ ID NO: 5086 - protein, 56 aa, Hepatitis C virus
RFKADTQSIEGQDSAVGTSSQPDSGPEEKRDDDSDAASYSSMPPLEGEPGDPDLSS

SEQ ID NO: 5087 - protein, 56 aa, Hepatitis C virus
MGGNMTRIESESKVLMVDSFDPVVDKEDEREPSIPSEYLLPKSRFPPALPPWARPD

SEQ ID NO: 5088 - protein, 56 aa, Hepatitis C virus
YPGTITGHRMAWDMMMNWSPTATMILAYAMRVPEVIIDIIGGAHWGVMFGLAYFSM

SEQ ID NO: 5089 - protein, 56 aa, Hepatitis C virus
LVETWKKPDYEPPVVHGCPLPPPRSPPVPPPRKKRTVVLTESTLPTALAELATKSF

SEQ ID NO: 5090 - protein, 56 aa, Hepatitis C virus
QIVGGVYLLPRRGPRLGVRAPRKTSERSQPRGRRQPIPKARRPEGRTWAQPGYPWP

SEQ ID NO: 5091 - protein, 56 aa, Hepatitis C virus
AIGSQLPCEPEPDVTVVTSMLVDPSHLTAEAAARRLARGSPPSCASSLASQLSAPS

SEQ ID NO: 5092 - protein, 56 aa, Hepatitis C virus
LYGNEGLGWAGWLLSPRGSRPSWGPTDPRHRSRNVGKVIDTLTCGFADLMGYIPVV

SEQ ID NO: 5093 - protein, 56 aa, Hepatitis C virus
YNPPLLETWKRPDYQPPVVAGCALPPPGTTPVPPPRRRRAVVLDQSNVGEALKELA

SEQ ID NO: 5094 - protein, 56 aa, Hepatitis C virus
DPTTPEDAGSEAESYSSMPPLEGEPGDPDLSSGSWSTVSDEDDVVCCSMSYSWTGA

SEQ ID NO: 5095 - protein, 56 aa, Hepatitis C virus
PDYNPPLLDRWKSPDYVPPTVHGCALPPKGAPPVPPPRRKRTIQLDGSNVSAALAA

SEQ ID NO: 5096 - protein, 56 aa, Hepatitis C virus
EECASQLPYIEQGMQLAEQFKQKALGLLQTATKQAEAAAPVVESKWRALETFWAKH

SEQ ID NO: 5097 - protein, 56 aa, Hepatitis C virus
TFETPSSPTTGYGSDQPDHSTESSEHDRDDGVASEAESYSSMPPLEGEPGDPDLSS

SEQ ID NO: 5098 - protein, 56 aa, Hepatitis C virus
HVDPGEGAVQWMNRLIAFASRGNHVSPTHYVPESDAAARVTQILSGLTITQLLRRL

SEQ ID NO: 5099 - protein, 56 aa, Hepatitis C virus
QIVGGVYLLPRRGPRLGVRATRKTWERSQPRGRRQPIPKARQPEGRAWAQPGYPWP

SEQ ID NO: 5100 - protein, 56 aa, Hepatitis C virus
QIVGGVYVLPRRGPKLGVRAVRKTSERSQPRSRRQPIPRARRTEGRSWAQPGYPWP

SEQ ID NO: 5101 - protein, 56 aa, Hepatitis C virus
RLHRYAPACRPLLREEVTFQVGLNQYLVGSQLPCEPEPDVAVLTSMLTDPSHITAE

SEQ ID NO: 5102 - protein, 56 aa, Hepatitis C virus
NWTRGERCNLEDRDRLELSPLLLSTTEWQVLPCSFTTLPALSTGLIHLHQNIVDVQ

SEQ ID NO: 5103 - protein, 56 aa, Hepatitis C virus
ETDEKVIILDSFESCVAEQNDDREVSVAAEILRPTKKFPPALPIWARPDYNPPLTE

SEQ ID NO: 5104 - protein, 56 aa, Hepatitis C virus
LYGNEGLGWAGWLLSPRGSRPSWGPTDPRRRSRNLGKVIDTLTCGFADLMGYIPLV

SEQ ID NO: 5105 - protein, 56 aa, Hepatitis C virus
LLESWKDPDYVPPVVHGCPLPPTKAPPIPPPRRKRTVVLTESNVSSALAELATKTF

SEQ ID NO: 5106 - protein, 56 aa, Hepatitis C virus
AEILRPTKKFPPALPIWARPDYNPPLTETWKQQDYQAPTVHGCALPPAKQPPVPSP

SEQ ID NO: 5107 - protein, 56 aa, Hepatitis C virus
PSLRATCTTSQKHPEMELLQANLLWKHEMGSHIPRVQSENKVVVLDSFELYPLEYE

SEQ ID NO: 5108 - protein, 56 aa, Hepatitis C virus
PPPRKKRTVVLTESTVSSALAELATKTFGSSGSSAVDSGTATAPPDQTSDDGDKES

SEQ ID NO: 5109 - protein, 56 aa, Hepatitis C virus
SVAAEILRKSKKFPPALPIWARPDYNPPLLESWKSPDYVPPAVHGCPLPPTTGPPI

SEQ ID NO: 5110 - protein, 56 aa, Hepatitis C virus
LEFVVGSQLPCEPEPDVTVVTSMLTDPSHITAETASRRLKRGSPPSLASSSASQLS

SEQ ID NO: 5111 - protein, 56 aa, Hepatitis C virus
DAESYSSMPPLEGEPGDPDLSDGSWSTVSSEANAEDVVCCSMSYSWTGALVTPCAA

SEQ ID NO: 5112 - protein, 56 aa, Hepatitis C virus
TYVVGSQLPCEPEPDVLVVTSMLRDPDHITAEEASRRLKRGSPPSLASSSASQLSA

SEQ ID NO: 5113 - protein, 56 aa, Hepatitis C virus
GSQLPCEPEPDVAVLTSMLTDPSHITAEAAGRRLARGSPPSVASSSASQLSAPSLK

SEQ ID NO: 5114 - protein, 56 aa, Hepatitis C virus
ATCTTHHDSPDADLIEANLLWRQEMGGNITRVESENKVVILDSFDPLRAEEDEREV

SEQ ID NO: 5115 - protein, 56 aa, Hepatitis C virus
RHIGPGEGAVQWMNRLIAFASRGNHVSPTHYVPETDASAKVTQLLSSLTVTSLLKR

SEQ ID NO: 5116 - protein, 56 aa, Hepatitis C virus
VIVGRIILSGRPAVIPDREVLYQEFDEMEECASHLPYIEQGMQLAEQFKQKALGLL

SEQ ID NO: 5117 - protein, 56 aa, Hepatitis C virus
PDPTTADDTCSDAGSFSSMPPLEGEPGDPDLSTGSWSTVSEEDDVVCCSMSYTWTG

SEQ ID NO: 5118 - protein, 56 aa, Hepatitis C virus
SFVVGSQLPCDPEPDTEVLASMLTDPSHITAEAAARRLARGSPPSQASSSASQLSA

SEQ ID NO: 5119 - protein, 56 aa, Hepatitis C virus
YPGHLSGHRMAWDMMMNWSPTTALVVSQLLRIPQTVVDMVTGAHWGVLAGLAYYSM

SEQ ID NO: 5120 - protein, 56 aa, Hepatitis C virus
EAESYSSMPPLEGEPGDPDLSDGSWSTVSSDGGTEDVVCCSMSYSWTGALITPCAS

SEQ ID NO: 5121 - protein, 56 aa, Hepatitis C virus
CGSLFLAGQLFTFQPRRHWTVQECNCSIYTGHVTGHRMAWDMMMSWSPTTTLVLSS

SEQ ID NO: 5122 - protein, 56 aa, Hepatitis C virus
YQGHITGHRMAWDMMLNWSPTLTMILAYAARVPELVLEVVFGGHWGVVFGLAYFSM

SEQ ID NO: 5123 - protein, 56 aa, Hepatitis C virus
PPPRKKRTVVLTESTLPTALAELATKSFGSSSTSGITGDNTTTSSEPAPSGCPPDS

SEQ ID NO: 5124 - protein, 56 aa, Hepatitis C virus
QFDEMEECSRHIPYLAEGQQIAEQFRQKVLGLLQASAKQAEELKPAVHSAWPRMEE

SEQ ID NO: 5125 - protein, 56 aa, Hepatitis C virus
VIVGRIILSGKPAVIPDREVLYREFDEMEECAAHIPYLEQGMHLAEQFKQKALGLL

SEQ ID NO: 5126 - protein, 56 aa, Hepatitis C virus
EGEDTPSEAGSYSSMPPLEGEPGDPDLSSGSWSTVSEEGDSVVCCSMSYSWTGALV

SEQ ID NO: 5127 - protein, 56 aa, Hepatitis C virus
ARRLARGSPPSLASSSASQLSAPSLKATCTTAGKHPDAELIEANLLWRQEVGGNIT

SEQ ID NO: 5128 - protein, 56 aa, Hepatitis C virus
KSFPTQPASTPDSDSGHPTTSKSSDQADEGEDTPSEAGSYSSMPPLEGEPGDPDLS

SEQ ID NO: 5129 - protein, 56 aa, Hepatitis C virus
QPRGRRQPIPKARQPTGRSWGQPGYPWPLYANEGLGWAGWLLSPRGSRPNWGPNDP

SEQ ID NO: 5130 - protein, 56 aa, Hepatitis C virus
YPGHLTGHRMAWDMMMNWSPAMTLIVSQVLRLPQTMFDLVIGAHWGVMAGVAYYSM

SEQ ID NO: 5131 - protein, 56 aa, Hepatitis C virus
GSQLPCEPEPDVAVLTSMLTDPSHITAAAAGRRLARGSPPSEASSSASQLSAPSLK

SEQ ID NO: 5132 - protein, 56 aa, Hepatitis C virus
QPRGRRQPIPKDRRSTGKSWGKPGYPWPLYGNEGCGWAGWLLSPRGSRPTWGPTDP

SEQ ID NO: 5133 - protein, 56 aa, Hepatitis C virus
VTRIESETKVLILDSLDPSVEEEDEREPSVPSEYLLPKKKFPQALPVWARPDYNPP

SEQ ID NO: 5134 - protein, 56 aa, Hepatitis C virus
NWTRGERCDLEDRDRSELSPLLLSTTEWQILPCSFTGLPALSTGLIHLHQNVVDVQ

SEQ ID NO: 5135 - protein, 56 aa, Hepatitis C virus
PPPRKKRTVVLTESTLSTALAELATRSFGSSSTSGITGDNTTTSSEPAPSGCPPDS

SEQ ID NO: 5136 - protein, 56 aa, Hepatitis C virus
HITAETASRRLKRGSPPSLASSSASQLSAPSLKATCTTSKDHPDMELIEANLLWRQ

SEQ ID NO: 5137 - protein, 56 aa, Hepatitis C virus
PPPRRKRTVVLTESSVSSALAELATKTFGSSESSAVDSGTATALPDQASDDGDKGS

SEQ ID NO: 5138 - protein, 56 aa, Hepatitis C virus
YPGHVSGHRMAWDMMMNWSPTTALVVSQLLRIPQAIVDMVAGAHWGVLAGLAYYSM

SEQ ID NO: 5139 - protein, 56 aa, Hepatitis C virus
LIETWKKPNYEPPVVHGCPLPPPQSPPVPPPRKKRTVVLTESTLSTALAELAAKSF

SEQ ID NO: 5140 - protein, 56 aa, Hepatitis C virus
PKPAPIPPPRRKRLVHLDESTVSRALAQLADKVFVEGSSDPGPSSDSGLSITSPDP

SEQ ID NO: 5141 - protein, 56 aa, Hepatitis C virus
DDGSYSSMPPLEGEPGDPDLTSDSWSTVSGSEDVVCCSMSYSWTGALVTPCAAEES

SEQ ID NO: 5142 - protein, 56 aa, Hepatitis C virus
NWTRGERCDLEDRDRSELSPLLLSTTEWQTLPCSFTTLPALSTGLIHLHQNIVDVQ

SEQ ID NO: 5143 - protein, 56 aa, Hepatitis C virus
CGAVFLAGQLATFSPRIHDITQDCNCSVYTGHVTGHRMAWDMMMNWSPTTTLVLSS

SEQ ID NO: 5144 - protein, 56 aa, Hepatitis C virus
CGSVFLVSQLFTFSPRRHVTLQDCNCSIYPGHVSGHRMAWDMMMNWSPTTALVVSQ

SEQ ID NO: 5145 - protein, 56 aa, Hepatitis C virus
QIVGGVYLLPRRGPRLGVRATRKTSERSQPRGRRQPIPKARPSQGRTWGQPGYPWP

SEQ ID NO: 5146 - protein, 56 aa, Hepatitis C virus
PDYNPPLLDRWKAPDYVPPTVHGCALPPRGAPPVPPPRRKRTIQLDGSNVSAALAA

SEQ ID NO: 5147 - protein, 56 aa, Hepatitis C virus
DVESYSSMPPLEGEPGDPDLSDGSWSTVSGEASDDIVCCSMSYTWTGALITPCAAE

SEQ ID NO: 5148 - protein, 56 aa, Hepatitis C virus
PAPTTPDDACSEAESYSSMPPLEGEPGDPDLSSGSWSTVSDQDDVVCCSMSYSWTG

SEQ ID NO: 5149 - protein, 56 aa, Hepatitis C virus
RLHRYAPVCKPLLREEVVFQVGLNQYLVGSQLPCEPEPDVAVLTSMLTDPSHITAE

SEQ ID NO: 5150 - protein, 56 aa, Hepatitis C virus
HINSTALNCNESLNTGWLAGLIYQHKFNSSGCPERLASCRRLTDFDQGWGPISHAN

SEQ ID NO: 5151 - protein, 41 aa, Hepatitis C virus
TGIVRFFAPGPKQNVHLINTNGSWHINSTALNCNDSLNTGW

SEQ ID NO: 5152 - protein, 56 aa, Hepatitis C virus
HINRTALNCNESLDTGWLAGLLYYHKFNSSGCPERMASCQPLTAFDQGWGPITHEG

SEQ ID NO: 5153 - protein, 56 aa, Hepatitis C virus
HLNSTALNCNDSLNTGWLAGLFYHHKFNSSGCPERLASCRPLTDFDQGWGPISYAN

SEQ ID NO: 5154 - protein, 56 aa, Hepatitis C virus
PLLETWKQPDYDPPQVSGCPLPPAGLPPVPPPRRKRKPVVLSDSNVSQVLADLAHA

SEQ ID NO: 5155 - protein, 56 aa, Hepatitis C virus
SVGCVVICGRITLTGKPAVVPDREILYQQFDEMEECSRHIPYLAEGQQIAEQFRQK

SEQ ID NO: 5156 - protein, 56 aa, Hepatitis C virus
QIVGGVYLLPRKGPRLGVRATRKTSERSQPRGRRQPIPKARQPQGRHWAQPGYPWP

SEQ ID NO: 5157 - protein, 56 aa, Hepatitis C virus
QPRGRRKPIPKARRSEGRSWAQPGYPWPLYGNEGCGWAGWLLSPRGSRPNWAPNDP

SEQ ID NO: 5158 - protein, 56 aa, Hepatitis C virus
PPVLETWKSPTYEPPVVHGCALPPSGPPPIPPPRRKKVVQLDSSNVSAALAQLAAK

SEQ ID NO: 5159 - protein, 56 aa, Hepatitis C virus
KLPPVPPPRRKRTIVLSESTVSKALASLAEKSFPQPTCSAEDESTSGVGTQSGSLT

SEQ ID NO: 5160 - protein, 56 aa, Hepatitis C virus
PPPRRKRTVVLSESTVSSALAELATKTFGSSESSAVDSGTATASPDQPSDDGDAGS

SEQ ID NO: 5161 - protein, 56 aa, Hepatitis C virus
NWTRGERCDLEDRDRSELSPLLLTTTQWQVLPCSFTTLPALSTGLIHLHQNIVDVQ

SEQ ID NO: 5162 - protein, 56 aa, Hepatitis C virus
QPRGRRQPIPKARQSQGRHWAQPGYPWPLYGNEGCGWAGWLLSPRGSRPNWGPNDP

SEQ ID NO: 5163 - protein, 56 aa, Hepatitis C virus
ITAEEASRRLKRGSPPSLASSSASQLSAPSLKATCTTHADHPDAELVEANLLWRQE

SEQ ID NO: 5164 - protein, 56 aa, Hepatitis C virus
NYAVGSQLPCEPEPDVTVVTSMLTDPTHITAETAARRLKKGSPPSLASSSANQLSA

SEQ ID NO: 5165 - protein, 56 aa, Hepatitis C virus
SHITAETAARRLARGSPPSEASSSASQLSAPSLKATCQTHRPHPDAELVDANLLWR

SEQ ID NO: 5166 - protein, 56 aa, Hepatitis C virus
CGSVFLVSQLFTFSPRRYETVQDCNCSIYPGHVSGHRMAWDMMMNWSPTAALVVSQ

SEQ ID NO: 5167 - protein, 56 aa, Hepatitis C virus
NWTRGERCNLEDRDRSELSPLLLSTTEWQILPCAFTTLPALSTGLIHLHQNIVDVQ

SEQ ID NO: 5168 - protein, 56 aa, Hepatitis C virus
YVTGMTTDNLKCPCQVPSPEFFTELDGVRLHRFAPPCKPLLREEVSFRVGLHEYPV

SEQ ID NO: 5169 - protein, 56 aa, Hepatitis C virus
NWTRGERCDLEDRDRPELSPLLLSTTEWQVLPCSFTTLPALSTGLIHLHQNIVDVQ

SEQ ID NO: 5170 - protein, 56 aa, Hepatitis C virus
TVGCVVICGRIVTSGKPAVVPDREVLYQQFDEMEECSKHIPYLVEGQQIAEQFKQK

SEQ ID NO: 5171 - protein, 56 aa, Hepatitis C virus
PPPRKKRTVVLTESTLSTALAELAAKSFGSSSTSGITGDNTTTSSEPAPSGCSPDS

SEQ ID NO: 5172 - protein, 56 aa, Hepatitis C virus
VGSQLPCEPEPDVTVLTSMLSDPAHITAETAKRRLDRGSPPSLASSSASQLSAPSL

SEQ ID NO: 5173 - protein, 56 aa, Hepatitis C virus
EECSQHLPYIEQGMMLAEQFKQKALGLLQTASRHAEVITPAVQTNWQKLEVFWAKH

SEQ ID NO: 5174 - protein, 56 aa, Hepatitis C virus
GSSESSAVDSGTATALPDQASDDGDKGSDVESYSSMPPLEGEPGDPDLSDGSWSTV

SEQ ID NO: 5175 - protein, 56 aa, Hepatitis C virus
VIVGRIILSGRPAVVPDREVLYREFDEMEECASHLPYIEQGMQLAEQFKQKALGLL

SEQ ID NO: 5176 - protein, 56 aa, Hepatitis C virus
HITVETAKRRLDRGSPPSLASSSASQLSAPSRKATCTTHGRHPDAELITANLLWRQ

SEQ ID NO: 5177 - protein, 56 aa, Hepatitis C virus
YPGHITGHRMAWDMMMNWSPTTALVMAQLLRIPQAILDMIAGAHWGVLAGIAYFSM

SEQ ID NO: 5178 - protein, 56 aa, Hepatitis C virus
VGSQLPCEPEPDVTVVTSMLIDPSHVTAEAAARRLARGSPPSLASSSASQLSAPSL

SEQ ID NO: 5179 - protein, 56 aa, Hepatitis C virus
YPGHVSGHRMAWDMMMNWSPTTALVVSQLLRIPQAVVDMVAGAHWGVLAGLAYYSM

SEQ ID NO: 5180 - protein, 56 aa, Hepatitis C virus
LYGNEGCGWAGWLLSPRGSRPTWGPTDPRHRSRNLGKVIDTLTCGFADLMGYIPVV

SEQ ID NO: 5181 - protein, 56 aa, Hepatitis C virus
QIVGGVYLLPRRGPRLGVRATRKTSERSQPRGRRQPIPKARRQTGRAWGQPGYAWP

SEQ ID NO: 5182 - protein, 29 aa, Hepatitis C virus
QDIQLINTNGSWHINRTALNCNASLDTGW

SEQ ID NO: 5183 - protein, 56 aa, Hepatitis C virus
VIETWKRPDYEPPTVLGCALPPTPQAPVPPPRRRRARVLTQDNVEGVLREMADKVL

SEQ ID NO: 5184 - protein, 56 aa, Hepatitis C virus
DPAHITAATAARRLARGSPPSEASSSASQLSAPSLKATCQTHRPHPDAELIDANLL

SEQ ID NO: 5185 - protein, 56 aa, Hepatitis C virus
QEMGSNITRVESETKVVILDSFEPLRAETDDAELSAAAECFKKPPKYPPALPIWAR

SEQ ID NO: 5186 - protein, 56 aa, Hepatitis C virus
AQGARGLASLFTPGPQQNLQLINTNGSWHINRTALNCNDSLQTGFVAGLLYYHKFN

SEQ ID NO: 5187 - protein, 56 aa, Hepatitis C virus
LYGNEGLGWAGWLLSPRGSRPSWGPNDPRHRSRNVGKVIDTLTCGFADLMGYIPVV

SEQ ID NO: 5188 - protein, 56 aa, Hepatitis C virus
ARPDYNPPLLPSWKDPTYEPPAVHGCALPPTRPAPVPPPRRKRTIKLDGSNVSAAL

SEQ ID NO: 5189 - protein, 56 aa, Hepatitis C virus
TAACNFTRGDRCNLEDRDRSQLSPLLHSTTEWAILPCTYSDLPALSTGLLHLHQNI

SEQ ID NO: 5190 - protein, 56 aa, Hepatitis C virus
YSGHITGHRMAWDMMMNWSPTTALVMAQLLRIPQVVIDIIAGAHWGVLFAAAYYAS

SEQ ID NO: 5191 - protein, 56 aa, Hepatitis C virus
QIVGGVYLLPRRGPRLGVRATRKTSERSQPRGRRQPIPKARQSQGRHWAQPGYPWP

SEQ ID NO: 5192 - protein, 56 aa, Hepatitis C virus
PPPRRKRTVVLTESTVSSALAELATKTFGSSGSSAVDSGTATAPPDQASDDGDQGS

SEQ ID NO: 5193 - protein, 56 aa, Hepatitis C virus
YTGHVTGHRMAWDMMMSWSPTTTLVLSSILRVPEICASVIFGGHWGILLAVAYFGM

SEQ ID NO: 5194 - protein, 56 aa, Hepatitis C virus
RLHRYAPACKPLLREEVTFLVGLNQYLVGSQLPCEPEPDVAVLTSMLTDPSHITAE

SEQ ID NO: 5195 - protein, 56 aa, Hepatitis C virus
QLPCEPEPDVVILTSMLTDPDHITAETAARRLARGSPPSLASSSASQLSAPSLKAT

SEQ ID NO: 5196 - protein, 56 aa, Hepatitis C virus
EECASHLPYIEQGMQLAEQFKQKAIGLLQTATKQAEAAAPVVESKWRTLEAFWAKH

SEQ ID NO: 5197 - protein, 56 aa, Hepatitis C virus
CGSVFLVSQLITFSPRRYETVQDCNCSLYPGHVSGHRMAWDMMMNWSPTAALVVSQ

SEQ ID NO: 5198 - protein, 56 aa, Hepatitis C virus
CVVVCGRISTTGKPVLIPDREVLYQQFDEMEECSRHIPYLVEGQHLAEQFKQKVLG

SEQ ID NO: 5199 - protein, 56 aa, Hepatitis C virus
QPRSRRQPIPRARRTEGRSWAQPGYPWPLYGNEGCGWAGWLLSPRGSRPSWGPNDP

SEQ ID NO: 5200 - protein, 56 aa, Hepatitis C virus
CNWTYGERCDLEDRDRAELSPLLHTTTQWAILPCSFTPTPALSTGLIHLHQNIVDT

SEQ ID NO: 5201 - protein, 56 aa, Hepatitis C virus
FNAACNWTRGERCNLEDRDRSEMYPLLHSTTEQAILPCSFVPIPALSTGLIHLHQN

SEQ ID NO: 5202 - protein, 56 aa, Hepatitis C virus
CGSVFLVSQLFTFSPRRHETIQDCNCSIYPGHVSGHRMAWDMMMNWSPTTALVVSQ

SEQ ID NO: 5203 - protein, 56 aa, Hepatitis C virus
LIETWKRPGYEPPTVLGCALPPTPQTPVPPPRRRRAKVLTQDNVEGVLREMADKVL

SEQ ID NO: 5204 - protein, 56 aa, Hepatitis C virus
GSSSTSGITGDNTTTSSEPAPSGCPPDSDVESYSSMPPLEGEPGDPDLSDGSWSTV

SEQ ID NO: 5205 - protein, 56 aa, Hepatitis C virus
TWKQQDYQAPTVHGCALPPAKQPPVPSPRRKRTVQLTESVVSTALAELAAKTFGQS

SEQ ID NO: 5206 - protein, 56 aa, Hepatitis C virus
YPGTITGHRMAWDMMMNWSPTATMILAYVMRVPEVIIDIVSGAHWGVMFGLAYFSM

SEQ ID NO: 5207 - protein, 56 aa, Hepatitis C virus
NWTRGERCDLDDRDRAELSPLLLSTTQWQVLPCSFTTLPALSTGLIHLHQNIVDVQ

SEQ ID NO: 5208 - protein, 56 aa, Hepatitis C virus
LYGNEGCGWAGWLLSPRGSRPSWGPSDPRRRSRNLGKVIDTLTCGFADLMGYIPLV

SEQ ID NO: 5209 - protein, 56 aa, Hepatitis C virus
PPPRRKRTVVLDESTVSSALAELATKTFGSSTTSGVTSGEAAESSPAPSCDGELDS

SEQ ID NO: 5210 - protein, 56 aa, Hepatitis C virus
QIVGGVYLLPRRGPKLGVRATRKNSERSQPRGRRQPIPKARRPTGRSWGQPGYPWP

SEQ ID NO: 5211 - protein, 56 aa, Hepatitis C virus
PPPRRKRTVVLTESTVSSALAELATKTFGSSESSAAGSGTATAPPDQPSDDGDAGS

SEQ ID NO: 5212 - protein, 56 aa, Hepatitis C virus
GSQLPCEPEPDVAVLTSMLTDPSHITAETAARRLKRGSPPSLASSSASQLSAPSLK

SEQ ID NO: 5213 - protein, 56 aa, Hepatitis C virus
DVESCSSMPPLEGEPGDPDLSDGSWSTVSEEDGEGVICCSMSYTWTGALITPCAAE

SEQ ID NO: 5214 - protein, 56 aa, Hepatitis C virus
PPPRRKRTVVLDESTVSSALAELATKTFGSSTTSGVTSGEATESSPAPSCGGELDS

SEQ ID NO: 5215 - protein, 56 aa, Hepatitis C virus
TAASDAGSLSSMPPLEGEPGDPDLEFEPARSAPPSEGECEVIDSDSKSWSTVSDQE

SEQ ID NO: 5216 - protein, 56 aa, Hepatitis C virus
DSVTPIDTTIMAKNEVFCVQPEKGGRKPARLIVFPDLGVRVCEKMALYDVVSKLPL

SEQ ID NO: 5217 - protein, 56 aa, Hepatitis C virus
QFDEMEECSKHIPYLVEGQQIAEQFKQKVLGLLQAGTKHAEELKPAIHSTWPRVEE

SEQ ID NO: 5218 - protein, 56 aa, Hepatitis C virus
HINSTALNCNESLNTGWLAGLFYQHKFNSSGCPERLASCRRLTDFAQGWGPISYAN

SEQ ID NO: 5219 - protein, 56 aa, Hepatitis C virus
DDGVASEAESYSSMPPLEGEPGDPDLSSGSWSTVSEEGDSVVCCSYSYSWTGALVT

SEQ ID NO: 5220 - protein, 56 aa, Hepatitis C virus
DRASDDGSYSSMPPLEGEPGDPDLSSGSWSTVSEDHDSVVCCSMSYSWTGALITPC

SEQ ID NO: 5221 - protein, 56 aa, Hepatitis C virus
PPRKKRVVQLDEGSAKRALAELAQTSFPPSTATLSEDSGRETSTLSSDMTPPREEA

SEQ ID NO: 5222 - protein, 56 aa, Hepatitis C virus
CGSVFLVSQLFTFSPRRYETVQDCNCSIYPGHVTGHRMAWDMMMNWSPTTALVVSQ

SEQ ID NO: 5223 - protein, 56 aa, Hepatitis C virus
GSSGSSAVDSGTATAPPDQTSDDGDKESDVESYSSMPPLEGEPGDPDLSDGSWSTV

SEQ ID NO: 5224 - protein, 56 aa, Hepatitis C virus
AFGAVSLVGQAFTFRPRQHKTVQTCNCSIYPGHVSGHRMAWDMMMNWSPAIGLVIS

SEQ ID NO: 5225 - protein, 56 aa, Hepatitis C virus
GQPPPSGDSGLSTGADAADSGSRTPPDELALSETGSISSMPPLEGEPGDPDLEPEQ

SEQ ID NO: 5226 - protein, 56 aa, Hepatitis C virus
GSSESSAAGSGTATAPPDQPSDDGDAGSDVESCSSMPPLEGEPGDPDLSDGSWSTV

SEQ ID NO: 5227 - protein, 56 aa, Hepatitis C virus
AEKSFPATPDQPQTNSDSGHGTNGAASLPSAEDDDASDADSYSSMPPLEGEPGDPD

SEQ ID NO: 5228 - protein, 56 aa, Hepatitis C virus; identical to SEQ ID NO: 5132

SEQ ID NO: 5229 - protein, 56 aa, Hepatitis C virus
YPGHVTGHRMAWDMMMNWSPTGALVVAQLLRIPQAIVDMIAGAHWGVLAGLAYYSM

SEQ ID NO: 5230 - protein, 56 aa, Hepatitis C virus
SKGGRKPARLIVYPDLGVRVCEKMALYDVTQKLPQAVMGPAYGFQYSPNQRVEYLL

SEQ ID NO: 5231 - protein, 56 aa, Hepatitis C virus
DYNPPLLETWKAPDYDPPVVSGCALPPQGLPPVPPPRRKKLVQLDDSVVGHVLAQL

SEQ ID NO: 5232 - protein, 56 aa, Hepatitis C virus
RSKYGYGAKEVRSLDKKALNHIKGVWQDLLDDSDTPLPTTIMAKNEVFAVEPSKGG

SEQ ID NO: 5233 - protein, 56 aa, Hepatitis C virus
CGSIFLVSQLFTFSPRRHETVQDCNCSIYPGHVSGHRMAWDMMMNWSPTTALVVSQ

SEQ ID NO: 5234 - protein, 56 aa, Hepatitis C virus
CNWTRGERCDLEDRDRAELSPLLHTTTQWAILPCSFTPTPALSTGLIHLHQNIVDT

SEQ ID NO: 5235 - protein, 56 aa, Hepatitis C virus
NWTRGERCDLEDRDRSELSPLLLSTTEWQILPCSFTTLPALSTGLIHLHRNIVDVQ

SEQ ID NO: 5236 - protein, 56 aa, Hepatitis C virus
VGSVVICGRITTSSRPAVIPDREVMYQQYDEMEECSRHLPYLVEGQQLAEQFKQNV

SEQ ID NO: 5237 - protein, 56 aa, Hepatitis C virus
YDEMEECSRHLPYLVEGQQLAEQFKQNVLGLIQVTTKQAEELKPAVHSAWPKLEQF

SEQ ID NO: 5238 - protein, 56 aa, Hepatitis C virus
CGSIFLVGQLFTLSPRRHWTTQDCNCSIYPGHVTGHRMAWDMMMNWSPTGALVVAQ

SEQ ID NO: 5239 - protein, 56 aa, Hepatitis C virus
VDPAKGGRKPARLIVYPDLGVRVCEKRALYDVIQKLSIETMGPAYGFQYSPQQRVE

SEQ ID NO: 5240 - protein, 56 aa, Hepatitis C virus
SPAPNYSRALWRVAAEEYVEVTRVGDFHYVTGMTTDNVKCPCQVPAPEFFSEVDGV

SEQ ID NO: 5241 - protein, 56 aa, Hepatitis C virus
NSYVIGSQLPCEPEPDVAVVTSMLQDPSHITVETAKRRLDRGSPPSLASSSASQLS

SEQ ID NO: 5242 - protein, 56 aa, Hepatitis C virus
CGSVFLVSQLFTFSPRRYETVQDCNCSIYPGHVSGHRMAWDMMMNWSPTTALVVSQ

SEQ ID NO: 5243 - protein, 56 aa, Hepatitis C virus
WRQEMGSNITRVESETKVVILDSFEPLRAEEDDTELSIPAECFKKPPKYPPALPIW

SEQ ID NO: 5244 - protein, 56 aa, Hepatitis C virus
VRLHRYAPRCKPLLRDEVSFSVGLSSYAVGSQLPCEPEPDVTVVTSMLIDPSHVTA

SEQ ID NO: 5245 - protein, 56 aa, Hepatitis C virus
DSVTPIQTTIMAKNEVFCVQPEKGGRKPARLIVFPDLGVRVCEKMALYDVVSKLPP

SEQ ID NO: 5246 - protein, 56 aa, Hepatitis C virus
TETPIDTTIMAKNEVFCVQPEKGGRKPARLIVFPDLGVRVCEKMALYDVVSTLPQA

SEQ ID NO: 5247 - protein, 56 aa, Hepatitis C virus
QIVGGVYLLPRRGPRLGVRATRKTSERSQPRGRRQPIPKARRQTGRTWAQPGYPWP

SEQ ID NO: 5248 - protein, 56 aa, Hepatitis C virus
SPAPNYSRALWRVAAEEYVEITRVGDFHYVTGMTTDNVKCPCQVPAPEFFTELDGV

SEQ ID NO: 5249 - protein, 56 aa, Hepatitis C virus
ETKLPINALSNSLLRHHNLVYATTSRSASLRQKKVTFDRLQVLDDHYRDVLKEMKA

SEQ ID NO: 5250 - protein, 56 aa, Hepatitis C virus
RLHRYAPACRPLLREDVTFQVGLNQYLVGSQLPCEPEPDVAVLTSMLTDPSHITAE

SEQ ID NO: 5251 - protein, 56 aa, Hepatitis C virus
PSKGGRKPARLIVYPDLGVRVCEKMALYDVTRKLPQAVMGSAYGFQYSPNQRVEYL

SEQ ID NO: 5252 - protein, 56 aa, Hepatitis C virus
SYAVGSQLPCEPEPDADVLRSMLTDPPHITAETAARRLARGSPPSEASSSVSQLSA

SEQ ID NO: 5253 - protein, 56 aa, Hepatitis C virus
IKSFGCPPPSGDPGHSTGGGTTGETSKSPPDEPDDSEAGSVSSMPPLEGEPGDPDL

SEQ ID NO: 5254 - protein, 56 aa, Hepatitis C virus
HYPCTANFTIFKVRMYVGGVEHRLDAACNWTRGERCNLEDRDRLELSPLLLSTTEW

SEQ ID NO: 5255 - protein, 56 aa, Hepatitis C virus
EECASHLPYIEQGMQLAEQFKQKALGLLQTATKQAEAAAPVVESRWRALEAFWAKH

SEQ ID NO: 5256 - protein, 56 aa, Hepatitis C virus
ATCTTHHDSPDADLIEANLLWRQEMGGNITRVESENKVVILDSFEPLHAEGDEREI

SEQ ID NO: 5257 - protein, 56 aa, Hepatitis C virus
AKPTPIPPPRRKRLIQLDESAVSQALQQLADKVFVEDTSTSEPSSGLGGSIAGPSS

SEQ ID NO: 5258 - protein, 56 aa, Hepatitis C virus
ADKVFVESSNDPGPSSDSGLSITSPVPPDPTTPEDAGSEAESYSSMPPLEGEPGDP

SEQ ID NO: 5259 - protein, 56 aa, Hepatitis C virus
KPAPVPPPRRKRLVHLDESTVSHALAQLADKVFVESSNDPGPSSDSGLSITSPVPP

SEQ ID NO: 5260 - protein, 56 aa, Hepatitis C virus
YQGHITGHRMAWDMMLSWSPTLTMILAYAARVPELVLEIIFGGHWGVVFGLAYFSM

SEQ ID NO: 5261 - protein, 56 aa, Hepatitis C virus
GSSGSSAVDSGTATALPDLASDDGDKGSDVESYSSMPPLEGEPGDPDLSDGSWSTV

SEQ ID NO: 5262 - protein, 56 aa, Hepatitis C virus
VGCVVICGRITLTGKPAVVPDREILYQQFDEMEECSRHIPYLAEGQQIAEQFRQKV

SEQ ID NO: 5263 - protein, 56 aa, Hepatitis C virus
DNNPPFIQAWQMPGYEPPVVSGCAVAPPKPAPVPPPRRKRLVHLDESTVSHALAQL

SEQ ID NO: 5264 - protein, 56 aa, Hepatitis C virus
DNTTPIDTTIMAKNEVFCVKPEKGGRKPARLIVYPDLGVRVCEKRALYDVVKQLPI

SEQ ID NO: 5265 - protein, 56 aa, Hepatitis C virus
HVNRTALNCNDSLNTGWIAGLFYYHGFNSSGCSERLASCRSLTDFDQGWGPISYAG

SEQ ID NO: 5266 - protein, 56 aa, Hepatitis C virus
PDYNPPLLQKWQMPGYEPPVVSGCALPPAKPTPIPPPRRKRLIQLDESAVSQALQQ

SEQ ID NO: 5267 - protein, 56 aa, Hepatitis C virus
CGPVFLVGQAFTFRPRRHRTVQTCNCSLYPGHLSGQRMAWDMMMNWSPAVGMVVAH

SEQ ID NO: 5268 - protein, 56 aa, Hepatitis C virus
VVICGRISTSGKPVLIPDREVLYQQFDEMEECSRHIPYLAEGHLIAEQFKQKVLGL

SEQ ID NO: 5269 - protein, 56 aa, Hepatitis C virus
PPPRRKRTVVLTESNVSSALAELATKTFGSSGSSAVDSGTATALPDLASDDGDKGS

SEQ ID NO: 5270 - protein, 56 aa, Hepatitis C virus
PSKGGRKPARLIVYPDLSVRVCEKMALYDVTQKLPKTVMGSAYGFQYSPSQRVEYL

SEQ ID NO: 5271 - protein, 56 aa, Hepatitis C virus
NWTRGERCDLEDRDRSELSPLLLSTTQWQVLPCSFTTLPALSTGLIHLHQNIVDVQ

SEQ ID NO: 5272 - protein, 56 aa, Hepatitis C virus
SPAPNYSRALWRVAAEEYVEVRRVGDFHYVTGMTTDNVKCPCQVPAPEFFTEVDGV

SEQ ID NO: 5273 - protein, 56 aa, Hepatitis C virus
HINRTALNCNDSLQTGFLASLFYTHKFNSSGCPERLSSCRGLDDFRIGWGTLEYET

SEQ ID NO: 5274 - protein, 56 aa, Hepatitis C virus
MTRYSAPPGDAPQPTYDLELITSCSSNVSVARDDKGKRYYYLTRDATTPLARAAWE

SEQ ID NO: 5275 - protein, 56 aa, Hepatitis C virus
GYGAKDVRNLSSKAVNHIRSVWKDLLEDTETPIDTTIMAKNEVFCVQPEKGGRKPA

SEQ ID NO: 5276 - protein, 56 aa, Hepatitis C virus
KASTVKAKLLSVEEACKLTPPHSAKSKFGYGAKDVRNLSSKAVNHIHSVWKDLLED

SEQ ID NO: 5277 - protein, 56 aa, Hepatitis C virus
SWTGAIITPCSAEEEKLPISPLSNSLLRHHNLVYSTSSRSAAARQKKVTFDRLQVL

SEQ ID NO: 5278 - protein, 56 aa, Hepatitis C virus
QCCDLDPQARVAIRSLTERLYVGGPLTNSRGENCGYRRCRASGVLTTSCGNTLTCY

SEQ ID NO: 5279 - protein, 56 aa, Hepatitis C virus
FGYGAKDVRCHARKAVNHINSVWKDLLEDSVTPIQTTIMAKNEVFCVQPEKGGRKP

SEQ ID NO: 5280 - protein, 56 aa, Hepatitis C virus
GYGAKDVRNLSSKAVNHIHSVWKDLLEDTVTPIDTTIMAKNEVFCVQPEKGGRKPA

SEQ ID NO: 5281 - protein, 56 aa, Hepatitis C virus
TVTPIDTTIMAKNEVFCVQPEKGGRKPARLIVFPDLGVRVCEKMALYDVVSTLPQV

SEQ ID NO: 5282 - protein, 56 aa, Hepatitis C virus
SEEASEDVVCCSMSYTWTGALITPCAAEETKLPINALSNSLLRHHNLVYATTSRSA

SEQ ID NO: 5283 - protein, 56 aa, Hepatitis C virus
HYPCTINHSIFKVRMYVGGVEHRLDAACNWTRGERCDLEDRDRSELSPLLLSTTQW

SEQ ID NO: 5284 - protein, 56 aa, Hepatitis C virus
ARSKFGYGAKDVRSHASKAINHINSVWADLLEDTQTPIPTTIMAKNEVFCVDASKG

SEQ ID NO: 5285 - protein, 56 aa, Hepatitis C virus
SAACNFTRGDRCRLEDRDRGQQSPLLHSTTEWAVLPCSFSDLPALSTGLLHLHQNI

SEQ ID NO: 5286 - protein, 56 aa, Hepatitis C virus
NWTRGEVCGLEHRDRVELSPLLLTTTAWQILPCSFTTLPALSTGLIHLHQNIVDVQ

SEQ ID NO: 5287 - protein, 56 aa, Hepatitis C virus
SKFGYGAKEVRGLASKAVNHINSVWEDLLEDNSTPIPTTIMAKNEVFCVDAQKGGR

SEQ ID NO: 5288 - protein, 56 aa, Hepatitis C virus
LYRNEGLGWAGWLLSPRGSRPSWGPSDPRHKSRNLGKVIDTLTCGFADLMGYIPVV

SEQ ID NO: 5289 - protein, 56 aa, Hepatitis C virus
PPTRPAPVPPPRRKRTIKLDGSNVSAALLALAERSFPSTKPEGTGTSSSGVGTEST

SEQ ID NO: 5290 - protein, 56 aa, Hepatitis C virus
VIVGRIILSGRPAIVPDRELLYQEFDEMEECASHLPYIEQGMQLAEQFKQKALGLL

SEQ ID NO: 5291 - protein, 56 aa, Hepatitis C virus
NWTRGERCNLEDRDRSELSPLLLSTTEWQVLPCSFTTLPALSTGLIHLHQNVVDVQ

SEQ ID NO: 5292 - protein, 56 aa, Hepatitis C virus
FDAACNWTRGDRCDLYDRDRIEMSPLLFSTTQLAILPCSFTTMPALSTGLIHLHQN

SEQ ID NO: 5293 - protein, 56 aa, Hepatitis C virus
PSHSARSKYGYGAQDVRSHASKAINHIRSVWEDLLEDSDTPIPTTIMAKNEVFCVD

SEQ ID NO: 5294 - protein, 56 aa, Hepatitis C virus
RVGPGEGAVQWMNRLIAFASRGNHVSPTHYVPESDAAARVTAILSSLTVTQLLRRL

SEQ ID NO: 5295 - protein, 56 aa, Hepatitis C virus
TKSLEPCTCGAVDLYLVTRNADVIPARRRGDKRGALLSPRPLSTLKGSSGGPVLCP

SEQ ID NO: 5296 - protein, 56 aa, Hepatitis C virus
CGAVFLVGQAFTFRPRRHQTVQTCNCSLYPGHLSGHRMAWDMMMNWSPAVGMVVAH

SEQ ID NO: 5297 - protein, 56 aa, Hepatitis C virus
DLLEDTQTPIPTTIMAKNEVFCVDASKGGRKSARLIVYPDLGVRVCEKRALFDVTR

SEQ ID NO: 5298 - protein, 56 aa, Hepatitis C virus
PPPRRRRALVLSQSNVGEALQALAIKSFGQLPPSCDSGRSTGMDTTDATDQPALKE

SEQ ID NO: 5299 - protein, 56 aa, Hepatitis C virus
HHNLVYSTSSRSAAARQKKVTFDRLQVLDDHYKNVLKEVKERASGVKGRLLSFEEA

SEQ ID NO: 5300 - protein, 56 aa, Hepatitis C virus
QAACNFTRGDRCNLEDRDRSQLSPLLHSTTEWAILPCSYTDLPALSTGLLHLHQNI

SEQ ID NO: 5301 - protein, 56 aa, Hepatitis C virus
SSDGGTEDVVCCSMSYSWTGALITPCAAEETKLPINALSNSLLRHHNLVYSTTSRS

SEQ ID NO: 5302 - protein, 56 aa, Hepatitis C virus
CGRIVTSGKPVPLPDREVLYRQFDEMEECSRHIPYLAEGQQIAEQFKQKILGLLQN

SEQ ID NO: 5303 - protein, 56 aa, Hepatitis C virus
INPLSNSLLRYHNKVYCTTSKSASLRAKKVTFDRMQALDAHYDSVLKDIKLAASKV

SEQ ID NO: 5304 - protein, 56 aa, Hepatitis C virus
GSQLPCEPEPDVAVLTSMLTDPSHITAETAARRLNRGSPPSLASSSASQLSAPSLK

SEQ ID NO: 5305 - protein, 56 aa, Hepatitis C virus
ESKLPINPLSNSLLRHHNMVYATTSRSASLRQKKVTFDRLQVLDDHYRDVLKEMKA

SEQ ID NO: 5306 - protein, 56 aa, Hepatitis C virus
SRVKPRLLTTEEACDLTPPHSARSKFGYGKKDVRSHSRKAINHISSVWKDLLDDNN

SEQ ID NO: 5307 - protein, 56 aa, Hepatitis C virus
FGYGAKDVRCHARKAVAHINSVWKDLLEDSVTPIDTTIMAKNEVFCVQPEKGGRKP

SEQ ID NO: 5308 - protein, 56 aa, Hepatitis C virus
EETKLPINALSNSLLRHHNLVYSTTSRSAGQRQKKVTFDRLQVLDDHYRDVLKEAK

SEQ ID NO: 5309 - protein, 56 aa, Hepatitis C virus
VDGVQIHRFAPIPKPFFRDEVSFCVGLNSFVVGSQLPCDPEPDTDVLTSMLTDPSH

SEQ ID NO: 5310 - protein, 56 aa, Hepatitis C virus
HVGPGEGAVQWMNRLIAFASRGNHVSPTHYVPESDAARRVTTILSSLTVTSLLRRL

SEQ ID NO: 5311 - protein, 56 aa, Hepatitis C virus; identical to SEQ ID NO: 4873

SEQ ID NO: 5312 - protein, 56 aa, Hepatitis C virus
HINRTALNCNDSLNTGFLAALFYTHKFNASGCPERLASCRPIDKFDQGWGPITYAE

SEQ ID NO: 5313 - protein, 56 aa, Hepatitis C virus
LVESWKRPDYQPATVAGCALPPPKKTPTPPPRRRRTVGLSESSIADALQQLAIKSF

SEQ ID NO: 5314 - protein, 56 aa, Hepatitis C virus
EEQKLPINALSNSLLRHHNLVYSTTSRSACQRKKKVTFDRLQVLDSHYQDVLKEVK

SEQ ID NO: 5315 - protein, 56 aa, Hepatitis C virus
QIVGGVCLLPRRGPRVGVRATRKTSERSQPRGRRQPIPKARRPEGRSWAQPGYPWP

SEQ ID NO: 5316 - protein, 56 aa, Hepatitis C virus
TARLLTLEEACQLTPPHSARSKYGFGAKEVRSLSGRAVNHIKSVWKDLLEDTQTPI

SEQ ID NO: 5317 - protein, 56 aa, Hepatitis C virus
SSGADTEDVVCCSMSYSWTGALVTPCAAEEQKLPINALSNSLLRHHNLVYSTTSRS

SEQ ID NO: 5318 - protein, 56 aa, Hepatitis C virus
CGSVFLVGQLFTFSPRRHWTTQGCNCSIYPGHITGHRMAWDMMMNWSPTTALVVAQ

SEQ ID NO: 5319 - protein, 56 aa, Hepatitis C virus
KLPISPLSNSLLRHHNMVYATTTRSAVTRQKKVTFDRLQVVDSTYNEVLKEIKARA

SEQ ID NO: 5320 - protein, 56 aa, Hepatitis C virus
SARRRLARGSRPSLASSSASQLSPRLLQATCTAPHDSPGTDLLEANLLWGSTATRV

SEQ ID NO: 5321 - protein, 56 aa, Hepatitis C virus
ATCTAPHDSPGTDLLEANLLWGSTATRVETDEKVIILDSFESCVAEQNDDREVSVA

SEQ ID NO: 5322 - protein, 56 aa, Hepatitis C virus
PCAAEEEKLPINPLSNSLIRHHNLVYSTSSRSAATRQKKVTFDRVQLLDQHYYDTV

SEQ ID NO: 5323 - protein, 56 aa, Hepatitis C virus
RRKRTVQLTESVVSTALAELAAKTFGQSEPSSDRDTDLTTPTETTDSGPIVVDDAS

SEQ ID NO: 5324 - protein, 56 aa, Hepatitis C virus
SGEASDDIVCCSMSYTWTGALITPCAAEESKLPINALSNSLLRHHNMVYATTSRSA

SEQ ID NO: 5325 - protein, 56 aa, Hepatitis C virus
GKKDVRSHSRKAINHISSVWKDLLDDNNTPIPTTIMAKNEVFAVNPAKGGRKPARL

SEQ ID NO: 5326 - protein, 56 aa, Hepatitis C virus
FGYGAKDVRSHSSKAIRHINSVWQDLLEDNTTPIDTTIMAKNEVFCVKPEKGGRKP

SEQ ID NO: 5327 - protein, 56 aa, Hepatitis C virus
DLTPAHSARSKFGYGAKDVRGRTSKALNHINSVWEDLLEDNVTPIPTTIMAKNEVF

SEQ ID NO: 5328 - protein, 56 aa, Hepatitis C virus
SVWEDLLEDSDTPIPTTIMAKNEVFCVDPSKGGRKPARLIVYPDLGVRVCEKMALY

SEQ ID NO: 5329 - protein, 56 aa, Hepatitis C virus
CGSLFLAGQLFAFQPRRHWTVQDCNCSIYTGHVTGHKMAWDMMMNWSPTTTLVLSS

SEQ ID NO: 5330 - protein, 56 aa, Hepatitis C virus
IRSVWEDLLEDTTTPIPTTIMAKNEVFCVDPAKGGRKAARLIVYPDLGVRVCEKRA

SEQ ID NO: 5331 - protein, 56 aa, Hepatitis C virus
GSQLPCEPEPDVAVLTSMLTDPSHITAEAAGRRLARGSPPSMASSSASQLSAPSLK

SEQ ID NO: 5332 - protein, 56 aa, Hepatitis C virus
FDEMEECASRAALIEEGQRIAEMLKSKIQGLLQQASKQAQDIQPAVQASWPKVEQF

SEQ ID NO: 5333 - protein, 56 aa, Hepatitis C virus
ILRRHVGQGEGAVQWMNRLIAFASRGNHVAPTHYVVESDASQRVTQVLSSLTITSL

SEQ ID NO: 5334 - protein, 56 aa, Hepatitis C virus
QPRGRRQPIPKARRPEGRTWAQPGYPWPLYGNEGMGWAGWLLSPRGSRPSWGPTDP

SEQ ID NO: 5335 - protein, 56 aa, Hepatitis C virus
HINSVWEDLLEDNVTPIPTTIMAKNEVFCVDVSKGGRKPARLIVYPDLSVRVCEKR

SEQ ID NO: 5336 - protein, 56 aa, Hepatitis C virus
ARAMSGLVSLFTPGAKQNIQLINTNGSWHINSTALNCNESLNTGWLAGLIYQHKFN

SEQ ID NO: 5337 - protein, 56 aa, Hepatitis C virus
TPIPTTIMAKNEVFAVNPAKGGRKPARLIVYPDLGSRVCEKRALHDVIKKTALAVM

SEQ ID NO: 5338 - protein, 56 aa, Hepatitis C virus
QHYYDTLKEMKARASTVSAKLLSVEEACDLTPAHSARSKFGYGAKDVRGRTSKALN

SEQ ID NO: 5339 - protein, 56 aa, Hepatitis C virus
EMEECSRHIPYLVEGQHLAEQFKQKVLGLIQTTTRQAEEIEPVVHSAWPKLEQFWQ

SEQ ID NO: 5340 - protein, 56 aa, Hepatitis C virus
PDYNPPLLQAWQMPGYEPPVVSGCAVAPPKPAPIPPPRRKRLVHLDESTVSRALAQ

SEQ ID NO: 5341 - protein, 56 aa, Hepatitis C virus
CGSVFLVSQLFTFSPRRHETLQDCNCSIYPGHLSGHRMAWDMMMNWSPTTALVVSQ

SEQ ID NO: 5342 - protein, 56 aa, Hepatitis C virus
HINRTALNCNDSLHTGFMAALFYANKFNSSGCPERLSSCRGLDDFRIGWGTLEYET

SEQ ID NO: 5343 - protein, 56 aa, Hepatitis C virus
TETPIDTTIMAKSEVFCVQPEKGGRKPARLIVFPDLGVRVCEKMALYDVVSTLPQA

SEQ ID NO: 5344 - protein, 56 aa, Hepatitis C virus
ESKLPINALSNSLLRHHNMVYATTSRSASLRQKKVTFDRLQVLDDHYRDVLKEMKA

SEQ ID NO: 5345 - protein, 56 aa, Hepatitis C virus
QIVGGVYLLPRRGPRLGVRATRKTSERSQPRGRRQPIPKARRPKGRNWAQPGYPWP

SEQ ID NO: 5346 - protein, 56 aa, Hepatitis C virus
KASTVKAKLLSIEEACKLTPPHSARSKFGYGAKDVRNLSSKAVNHIRSVWKDLLED

SEQ ID NO: 5347 - protein, 56 aa, Hepatitis C virus
PPVPPPRRKSVVHLDDSTVATALAELAEKSFPTQPASTPDSDSGHPTTSKSSDQAD

SEQ ID NO: 5348 - protein, 56 aa, Hepatitis C virus
LEDNSTPIPTTIMAKNEVFCVDAQKGGRKPARLIVYPDLGVRVCEKRALYDVTQKL

SEQ ID NO: 5349 - protein, 56 aa, Hepatitis C virus
SHSARSKYGYGAQDVRSRASKAVDHIPSVWEGLLEDSDTPIPTTIMAKNEVFCVDP

SEQ ID NO: 5350 - protein, 56 aa, Hepatitis C virus
GSSGSSAVDSGTATAPPDQASDDGDQGSDVESYSSMPPLEGEPGDPDLSDGSWSTV

SEQ ID NO: 5351 - protein, 56 aa, Hepatitis C virus
FFTELDGVRLHRYAPPCKPLLRDEITFSVGLHSYANGSQLSCEPEPDVAVLTSMLR

SEQ ID NO: 5352 - protein, 56 aa, Hepatitis C virus
SARSKFGYGAKDVRSHTSKAINHINSVWEDLLEDNQTPIPTTIMAKNEVFCADVSK

SEQ ID NO: 5353 - protein, 56 aa, Hepatitis C virus
EDLLEDNQTPIPTTIMAKNEVFCADVSKGGRKPARLIVYPDLGVRVCEKRALYDVT

SEQ ID NO: 5354 - protein, 56 aa, Hepatitis C virus
NHVSPTHYVPESDAAARVTALLSSLTVTSLLRRLHQWINEDYPSPCSDDWLRTIWD

SEQ ID NO: 5355 - protein, 56 aa, Hepatitis C virus
EECSQHLPYIEQGMMLAEQFKQKALGLLQTASRQAEVIAPAVQTNWQKLETFWAKH

SEQ ID NO: 5356 - protein, 56 aa, Hepatitis C virus
ESKLPINALSNSLLRHHNMVYATTSRSASQRQKKVTIDRLQVLDDHYRDVLKEMKA

SEQ ID NO: 5357 - protein, 56 aa, Hepatitis C virus
GSSTTSGVTSGEATESSPAPSCGGELDSEAESYSSMPPLEGEPGDPDLSDGSWSTV

SEQ ID NO: 5358 - protein, 56 aa, Hepatitis C virus
ITAETAARRLARGSPPSQASSSASQLSAPSLKATCTTHKTAYDCDMVDANLFMGGD

SEQ ID NO: 5359 - protein, 56 aa, Hepatitis C virus
TETPIDTTVMAKSEVFCVQPEKGGRKPARLIVFPDLGVRVCEKMALYDVVSTLPQA

SEQ ID NO: 5360 - protein, 56 aa, Hepatitis C virus
FDEMEECASRAALIEEGQRIAEMLKSKIQGLLQQASKQAQDIQPAMQASWPKVEQF

SEQ ID NO: 5361 - protein, 56 aa, Hepatitis C virus
VAIVGRIILSGRPAITPDREVLYQQFDEMEECSASLPYVDEARAIAGQFKEKVLGL

SEQ ID NO: 5362 - protein, 56 aa, Hepatitis C virus
SVWEDLLEDNTTPIPTTIMAKNEVFAVAPHKGGRKPARLIVYPDLGVRICEKRALY

SEQ ID NO: 5363 - protein, 56 aa, Hepatitis C virus
PSHSARSKFGYGAKEVRSLSSKAINHINSVWEDLLEDNTTPIPTTIMAKNEVFAVA

SEQ ID NO: 5364 - protein, 54 aa, Hepatitis C virus
ETHVTGGIAAKTTASLTGLFNLGAKQNIQLINTNGSWHINRTALNCNDSLNTGW

SEQ ID NO: 5365 - protein, 56 aa, Hepatitis C virus
ALITPCAAEEEKLPISPLSNSLLRHHNLVYSTSSRSAAQRQKKVTFDRLQVLDDHY

SEQ ID NO: 5366 - protein, 56 aa, Hepatitis C virus
SRSAGQRQKKVTFDRLQVLDDHYREVVDEMKRLASKVKARLLPLEEACGLTPPHSA

SEQ ID NO: 5367 - protein, 56 aa, Hepatitis C virus
VGSQLPCEPEPDVTVLTSMLSDPAHITAETAKRRLNRGSPPSLANSSASQLSAPSL

SEQ ID NO: 5368 - protein, 56 aa, Hepatitis C virus
IRSVWEDLLEDTTTPIPTTIMAKNEVFCVDPAKGGRKPARLIVYPDLGVRVCEKRA

SEQ ID NO: 5369 - protein, 56 aa, Hepatitis C virus
TTPVPPPRRRRAVVLDQSNVGEALKELAIKSFGCPPPSGDPGHSTGGGTTGETSKS

SEQ ID NO: 5370 - protein, 56 aa, Hepatitis C virus
AAGRRLARGSPPSVASSSASQLSAPSLKATCTANHDSPDAELIEANLLWRQEMGGN

SEQ ID NO: 5371 - protein, 56 aa, Hepatitis C virus
RFKVDTPSIEGQDSALGTSSQHDSGPEEKRDDNSDAASYSSMPPLEGEPGDPDLSS

SEQ ID NO: 5372 - protein, 56 aa, Hepatitis C virus
KASTVKAKLLSVEEACKLTPPHSARSKFGYGAKDVRNLSGKAINHIRSVWKDLLED

SEQ ID NO: 5373 - protein, 56 aa, Hepatitis C virus
ITAETAARRLKKGSPPSLASSSANQLSAPSLRATCTTSQKHPEMELLQANLLWKHE

SEQ ID NO: 5374 - protein, 56 aa, Hepatitis C virus
CGALSLVGQMFTYKPRQHTTVQDCNCSIYSGHITGHRMAWDMMMKWSPTTALLMAQ

SEQ ID NO: 5375 - protein, 56 aa, Hepatitis C virus
SVWEDLLEDNATPIPTTIMAKNEVFCVDPSKGGRKPARLIVYPDLSVRVCEKMALY

SEQ ID NO: 5376 - protein, 56 aa, Hepatitis C virus
PPHSARSRYGYGARDVRSHTSKAVKHIDSVWEDLLEDNATPIPTTIMAKNEVFCVD

SEQ ID NO: 5377 - protein, 56 aa, Hepatitis C virus
MSTNPKPQRKKPNVTPTVAHRTSSSRVAVRSLVEFTCCRAGALDWVCARRGRLPSG

SEQ ID NO: 5378 - protein, 56 aa, Hepatitis C virus
MSTNPKPQKKKTNVTPTVAHRTSSSRVAVRSLVEFTCCRAGALDWVCARRERLPSG

SEQ ID NO: 5379 - protein, 56 aa, Hepatitis C virus
TPCAAEEEKLPINPLSNSLIRHHNLVYSTTTRSAAMRQKKVTFDRLQILDQHYNNV

SEQ ID NO: 5380 - protein, 56 aa, Hepatitis C virus
GYGAKDVRNLSGKAINHIRSVWKDLLEDTETPIDTTIMAKNEVFCVQPEKGGRKPA

SEQ ID NO: 5381 - protein, 56 aa, Hepatitis C virus
GYGAKDVRNLSSKAVNHIRSVWKDLLEDTETPIDTTVMAKSEVFCVQPEKGGRKPA

SEQ ID NO: 5382 - protein, 56 aa, Hepatitis C virus
PPPRRKRTVVLTESTVSSALAELATKTFGSSGSSAVDSGTATGPPDQASDDGDKGS

SEQ ID NO: 5383 - protein, 56 aa, Hepatitis C virus
TAACNFTRGDRCDLEDRDRSQLSPLLHSTTEWAILPCTYSDLPALSTGLLHLHQNI

SEQ ID NO: 5384 - protein, 56 aa, Hepatitis C virus
QCCDLDPQARVAIKSLTERLYVGGPLTNSRGENCGYRRCRASGVLTTSCGNTLTCY

SEQ ID NO: 5385 - protein, 56 aa, Hepatitis C virus
SPSVPVPAPNYKRALWRVSAEEYVEVERHGDRHYVVGVTADGLKCPCQVPGPEFFT

SEQ ID NO: 5386 - protein, 56 aa, Hepatitis C virus
KNGSMKITGPRMCSNTWHGTFPINATTTSPSVPVPAPNYKRALWRVSAEEYVEVER

SEQ ID NO: 5387 - protein, 56 aa, Hepatitis C virus
DNVTPIDTTIMAKNEVFCVQPEKGGRKPARLIVFPDLGVRVCEKMALYDVVTKLPL

SEQ ID NO: 5388 - protein, 56 aa, Hepatitis C virus
FGYGAKDVRCHARKAVTHINSVWKDLLEDNVTPIDTTIMAKNEVFCVQPEKGGRKP

SEQ ID NO: 5389 - protein, 56 aa, Hepatitis C virus
NHVSPAHYVPESDAAARVTALLSSLTVTSLLRRLHQWINEDYPSPCSGDWLRIIWD

SEQ ID NO: 5390 - protein, 56 aa, Hepatitis C virus
EEQKLPINALSNSLLRHHNLVYSTTSRSACQRQKKVTFDRLQVLDSHYQDVLKEVK

SEQ ID NO: 5391 - protein, 56 aa, Hepatitis C virus
DLSSGSWSTVSDEDDVVCCSMSYSWTGALITPCAAEEEKLPINPLSNSLVRHHNMV

SEQ ID NO: 5392 - protein, 56 aa, Hepatitis C virus
INRTALNCNDSLQTGFLASLFYTHKFNSSGCPERMAACKPLAEFRQGWGQITHKNV

SEQ ID NO: 5393 - protein, 56 aa, Hepatitis C virus
YTGHITGHRMAWDMMMNWSPTVTFITSSLLRVPQLLLEIALEGHWGVIGALLYYSM

SEQ ID NO: 5394 - protein, 56 aa, Hepatitis C virus
MSTLPKPQRKTKRNTIRRPQDVKFPGGGVIYVGVYVLPRRGPRLGVRATRKTSERS

SEQ ID NO: 5395 - protein, 56 aa, Hepatitis C virus
CSAEEEKLPINPLSNTLLRHHNLVYSTSSRSAGLRQKKVTFDRLQVLDDHYREVVD

SEQ ID NO: 5396 - protein, 56 aa, Hepatitis C virus
KGAPPVPPPRRKRTIQLDGSNVSAALAALAEKSFPSSKPQEENSSSSGVDTQSSTA

SEQ ID NO: 5397 - protein, 56 aa, Hepatitis C virus
LYQQYDEMEECSQSAPYIEQAQAIAQQFKDKVLGLLQRASQQEAEIRPIVQSQWQK

SEQ ID NO: 5398 - protein, 56 aa, Hepatitis C virus
SSDGGTEDVVCCSMSYSWTGALITPCASEEAKLPINALSNSLLRHHNLVYSTTSRS

SEQ ID NO: 5399 - protein, 56 aa, Hepatitis C virus
YTGHVTGHKMAWDMMMNWSPTTTLVLSSILRVPEICASVIFGGHWGILLAVAYFGM

SEQ ID NO: 5400 - protein, 56 aa, Hepatitis C virus
VIVGRIVLSGRPAIIPDREVLYREFDEMEECSQHLPYIEQGMMLAEQFKQKALGLL

SEQ ID NO: 5401 - protein, 56 aa, Hepatitis C virus
PVYCFTPSPVVVGTTDRSGAPTYSWGENDTDVFVLNNTRPPLGNWFGCTWMNSTGF

SEQ ID NO: 5402 - protein, 56 aa, Hepatitis C virus
GHTVSGFVSLLAPGAKQNVQLINTNGSWHLNSTALNCNDSLNTGWLAGLFYHHKFN

SEQ ID NO: 5403 - protein, 56 aa, Hepatitis C virus
EECSQHLPYIEQGMMLAEQFKQKALGLLQTASRQAEVIAPTVQTNWQKLEAFWAKH

SEQ ID NO: 5404 - protein, 56 aa, Hepatitis C virus
FDAACNWTRGERCELHDRDRIEMSPLLFSTTQLAILPCSFSTMPALSTGLIHLHQN

SEQ ID NO: 5405 - protein, 56 aa, Hepatitis C virus
AILRRHVGPGEGAVQWMNRLIAFASRGNHVAPTHYVPESDAAAKVTALLSSLTVTQ

SEQ ID NO: 5406 - protein, 56 aa, Hepatitis C virus
ELDGVRLHRYAPVCRPLLRDDVTFTVGLNSYVIGSQLPCEPEPDVAVVTSMLQDPS

SEQ ID NO: 5407 - protein, 56 aa, Hepatitis C virus
GRTTAGLVGLLTPGAKQNIQLINTNGSWHINSTALNCNESLNTGWLAGLFYQHKFN

SEQ ID NO: 5408 - protein, 56 aa, Hepatitis C virus
LLDDSDTPLPTTIMAKNEVFAVEPSKGGKKPARLIVYPDLGVRVCEKRALYDVAQK

SEQ ID NO: 5409 - protein, 56 aa, Hepatitis C virus
HINRTALNCNDSLQTGFLASLFYAHRFNASGCPERMASCRSIDKFDQGWGPITYTE

SEQ ID NO: 5410 - protein, 56 aa, Human herpesvirus 6A
PKNSIYLKSKSQQSTTKFTDAEHTTPILKFTTWQNTARTYMSHNTEVQNMTDRFQR

SEQ ID NO: 5411 - protein, 56 aa, Human herpesvirus 6A
TTNATQKIESTTFTTIGIKEINGNTYSSPKNSIYLKSKSQQSTTKFTDAEHTTPIL

SEQ ID NO: 5412 - protein, 56 aa, Human herpesvirus 6A
DTIKVTPNTPTITTQTTESIKKIVKRSDFPRPMYTPTDIPTLTIRLNATIKTEQNT

SEQ ID NO: 5413 - protein, 56 aa, Human herpesvirus 6A
EPPAGILAGPQVKPQEKPPAEPPAGLPAGPQAKPPVKPQAKPPAEPPVGILAGPQA

SEQ ID NO: 5414 - protein, 56 aa, Human herpesvirus 6A
KDDSDGTEAKHCFMNHFVPIKTDDEDYDKNNVSYIYNKIQNSKIDSGDIIPTKKLI

SEQ ID NO: 5415 - protein, 56 aa, Human herpesvirus 6A
RDSVEGFIQEITPSIIDQNKLMLNRGQFRKRSAIDTGERDVRDLFKKQIIKCMEEQ

SEQ ID NO: 5416 - protein, 56 aa, Human herpesvirus 6A
TGTPFVLNNSDVAGSEAKHTTYSTETGVSPRNVFLIKDLRGKDGFRKQKQSDIPKS

SEQ ID NO: 5417 - protein, 46 aa, Human herpesvirus 6A
KMLKAIKSLDESYRRKPSSSESHASKPSLIDRIRYRGYKSVNVEEA

SEQ ID NO: 5418 - protein, 56 aa, Human herpesvirus 6A
RKEIQEAIEREKNSFAQLSNFIDKLGETPALPIESENVHKVHTSDITEGIVPRFIT

SEQ ID NO: 5419 - protein, 56 aa, Human herpesvirus 6A
TTLKSSNELPTIQTLSVTPKQKLPSNVTAKTEVHITNNALPSSNSSYSITEVTKEV

SEQ ID NO: 5420 - protein, 56 aa, Human herpesvirus 6A
FVPAQLMKVETPEEKDDIIEQMVLRIRQDGETDENTVSGPGVAESLDIEAKGESAI

SEQ ID NO: 5421 - protein, 56 aa, Human herpesvirus 6A
KHTRMSASTHEEINHTEIAQITPILNAHTSEKSTTPQRSFTAETFLTTSSKPAILT

SEQ ID NO: 5422 - protein, 56 aa, Human herpesvirus 6A
GPQAKPPVKPQAKPPAEPPVGILAGPQAEPQAEPPAGILAEPPAEPPVGILAGPQV

SEQ ID NO: 5423 - protein, 56 aa, Human herpesvirus 6A
KFTTWQNTARTYMSHNTEVQNMTDRFQRTTLKSSNELPTIQTLSVTPKQKLPSNVT

SEQ ID NO: 5424 - protein, 56 aa, Human herpesvirus 6A
QYLLSKEMTWPSLDIARSKDYDHMRMKFHIYDAVETLMFTDSIENLPFQYRHFVIP

SEQ ID NO: 5425 - protein, 56 aa, Human herpesvirus 6A
KILEVSNPQDMFKNFRLQNDLDSVQSPFRLPDADLSRELDSASFKDALDLKLPGNG

SEQ ID NO: 5426 - protein, 56 aa, Human herpesvirus 6A
NSPDSLTIVRRKKHKSGSSSISSSIEENCRSNSHIVTGKEKFTPFYYQSSRTRSSS

SEQ ID NO: 5427 - protein, 56 aa, Human herpesvirus 6A
VAVSEKEEGMADVSGQVSDDEYSQEAALKMLKAIKSLDESYRRKPSSSESHASKPS

SEQ ID NO: 5428 - protein, 56 aa, Human herpesvirus 6A
EREIDLALEKVKVGETETSDLKVGQDESFVPAQLMKVETPEEKDDIIEQMVLRIRQ

SEQ ID NO: 5429 - protein, 56 aa, Human herpesvirus 6A
TRGIKIMFSRHTQTDRSEVMCNAATQTGDVVDNSSETLFLGKNLVHQSILETEVKT

SEQ ID NO: 5430 - protein, 29 aa, Human herpesvirus 6A
EEYLNTLQNAPCLLLKPSVFRNIYSQEGK

SEQ ID NO: 5431 - protein, 56 aa, Human herpesvirus 6A
LTSPHIPSTNIPTPEPPPVTKNSTKLHTDTIKVTPNTPTITTQTTESIKKIVKRSD

SEQ ID NO: 5432 - protein, 56 aa, Human herpesvirus 6A
SADKNLTDNSPIRSNLNPTAFNKSNNNKSITNSTSNSDECTDKKPNCNSTKNESKD

SEQ ID NO: 5433 - protein, 56 aa, Human herpesvirus 6A
GLSLPQVIKRLNQNEGRASSRASSSHSTSTIPYSPPQSGRSTPTSILRQRAPIRSN

SEQ ID NO: 5434 - protein, 56 aa, Human herpesvirus 6A
RLPDADLSRELDSASFKDALDLKLPGNGEREIDLALEKVKVGETETSDLKVGQDES

SEQ ID NO: 5435 - protein, 56 aa, Human herpesvirus 6A
KEESRFERMGKQDDGKGDRSHKNDDGSALASKQEMQYKITNYMVPAKNGTAGSSLF

SEQ ID NO: 5436 - protein, 56 aa, Human herpesvirus 6A
AKTEVHITNNALPSSNSSYSITEVTKEVKHTRMSASTHEEINHTEIAQITPILNAH

SEQ ID NO: 5437 - protein, 56 aa, Human herpesvirus 6A
QAGLGQRVNNLLSQFTNLISLGEKGIEDILQNQRGTELKLATENKSGRESEEANVE

SEQ ID NO: 5438 - protein, 56 aa, Human herpesvirus 6A
SGSGEAAGEPGYEEEERRGRASTASATAATSTRGPTRPTRVTRKGRVATGGVHLSA

SEQ ID NO: 5439 - protein, 56 aa, Human herpesvirus 6A
DKEMTRNGQEPSRSLMGDARNAGDEQYIQAGLGQRVNNLLSQFTNLISLGEKGIED

SEQ ID NO: 5440 - protein, 56 aa, Human herpesvirus 6A
IKYTSDPLEAFKTVNRHNWSDEQREHFYDLRNLYTSFCQTNLSLDCFTQILTNVFS

SEQ ID NO: 5441 - protein, 30 aa, Human herpesvirus 6A
DGETDENTVSGPGVAESLDIEAKGESAIAS

SEQ ID NO: 5442 - protein, 56 aa, Human herpesvirus 6A
TLTPNQGKSLRRRLHGKFCNHLTEQKAFFNIEKNIETIEKDLGEAILNYGTVQSVA

SEQ ID NO: 5443 - protein, 56 aa, Human herpesvirus 6A
LASKQEMQYKITNYMVPAKNGTAGSSLFNEKEDSESDDSMHFDYSSNPNPKRQRCV

SEQ ID NO: 5444 - protein, 56 aa, Human herpesvirus 6A
NPVTTVSSVTGTTVVKTPSVKDVDGGTSVAVSEKEEGMADVSGQVSDDEYSQEAAL

SEQ ID NO: 5445 - protein, 56 aa, Human herpesvirus 6A
NGTFPVVNTGNPRTTLNCAPQLFLLGGNPTIAHPMNGNNETPDKNVCKPTPSTGVI

SEQ ID NO: 5446 - protein, 56 aa, Human herpesvirus 6A
VFTSWGTTLRFSNTKELIDAGLKQFTQDGEQTVKLAPHKTYLGISGQKISAVEKDF

SEQ ID NO: 5447 - protein, 56 aa, Human herpesvirus 6A
GEQTVKLAPHKTYLGISGQKISAVEKDFLMLVDSVVTELSFSHVAEYLDSVYDPSQ

SEQ ID NO: 5448 - protein, 56 aa, Human herpesvirus 6A
CRSNSHIVTGKEKFTPFYYQSSRTRSSSSSSSSSSASLSCSKSTLKTCRKTQNRDN

SEQ ID NO: 5449 - protein, 56 aa, Human herpesvirus 6A
TRPGKQTSETLTNKNLSEPKFKKPAVTGLMPKSQSIILSTDTNVPETSPDVKANTA

SEQ ID NO: 5450 - protein, 56 aa, Human herpesvirus 6A
SNVSPPWSRNTAANADFLDPVHRFVPEQTGTPFVLNNSDVAGSEAKHTTYSTETGV

SEQ ID NO: 5451 - protein, 56 aa, Human herpesvirus 6A
SPRNVFLIKDLRGKDGFRKQKQSDIPKSLTKERNDKAIMHSREVTGDSGDATETVG

SEQ ID NO: 5452 - protein, 56 aa, Human herpesvirus 6A
EFASIASKNMETDVSTSSDYLTGKSETTFSANSETWGKNVTEISIDSETYLNQSFM

SEQ ID NO: 5453 - protein, 56 aa, Human herpesvirus 6A
FSANSETWGKNVTEISIDSETYLNQSFMVTSTLAVETTDRSIGNNVNVTSSFPTVK

SEQ ID NO: 5454 - protein, 56 aa, Human metapneumovirus
NRRFLNVVRQFSDNAGITPAISLDLMTDAELARAVSNMPTSAGQIKLMLENRAMVR

SEQ ID NO: 5455 - protein, 56 aa, Human metapneumovirus
SETEPASTPDTTNRLSSVDRSTAQPSESRTKTKPTVHTRNNPSTASSTQSPPRATT

SEQ ID NO: 5456 - protein, 56 aa, Human metapneumovirus
MSFPEGKDILFMGNEAAKLAEAFQKSLRKPSHKRSQSIIGEKVNTVSETLELPTIS

SEQ ID NO: 5457 - protein, 56 aa, Human metapneumovirus
DNTVYQLSKVEGEQHVIKGRPVSSSFDPIKFPEDQFNVALDQVFENIENSQALVDQ

SEQ ID NO: 5458 - protein, 56 aa, Human metapneumovirus
GSNRVGIIKQLNKGCSYITNQDADTVTIDNTVYQLSKVEGEQHVIKGRPVSSSFDP

SEQ ID NO: 5459 - protein, 56 aa, Human metapneumovirus
KSYVVRQEYLNDKEHIVSLTGKERELSVGRMFAMQPGKQRQIQILAEKLLADNIVP

SEQ ID NO: 5460 - protein, 56 aa, Human metapneumovirus
EKKLKPSTNTKKKVSFTPNEPGKYTKLEKDALDLLSDNEEEDAESSILTFEERDTS

SEQ ID NO: 5461 - protein, 56 aa, Human metapneumovirus
RPTKPTILSEPKLAWTDKGGAIKTEAKQTIKVMDPIEEEEFTEKRVLPSSDGKTPA

SEQ ID NO: 5462 - protein, 30 aa, Human metapneumovirus
NFSSLGLTDEEKEAAEHFLNVSDDSQNDYE

SEQ ID NO: 5463 - protein, 56 aa, Human metapneumovirus
KTSSESEHHTSSPPTESNKEASTISTDNPDINPNSQHPTQQSTENPTLNPAASVSP

SEQ ID NO: 5464 - protein, 56 aa, Human metapneumovirus
KPSHKRSQSIIGEKVNTVSETLELPTISRPTKPTILSEPKLAWTDKGGAIKTEAKQ

SEQ ID NO: 5465 - protein, 56 aa, Human metapneumovirus
PDINPNSQHPTQQSTENPTLNPAASVSPSETEPASTPDTTNRLSSVDRSTAQPSES

SEQ ID NO: 5466 - protein, 42 aa, Human metapneumovirus
EKAKELNKIVEDESTSGESEEEEELKDTQENNQEDDIYQLIM

SEQ ID NO: 5467 - protein, 56 aa, Human metapneumovirus
TIKVMDPIEEEEFTEKRVLPSSDGKTPAEKKLKPSTNTKKKVSFTPNEPGKYTKLE

SEQ ID NO: 5468 - protein, 56 aa, Human metapneumovirus
TFNASDSLKTRRVLEYYLKDNKFDQKELKSYVVRQEYLNDKEHIVSLTGKERELSV

SEQ ID NO: 5469 - protein, 56 aa, Human metapneumovirus
TAGPTAARDGIRDAMIGIREELIADIIKEAKGKAAEMMEEEMNQRTKIGNGSVKLT

SEQ ID NO: 5470 - protein, 56 aa, Alphapapillomavirus 9
PNEFPFDENGNPVYELNDKNWKSFFSRTWSRLSLHEDEDKENDGDSLPTFKCVSGQ

SEQ ID NO: 5471 - protein, 56 aa, Alphapapillomavirus 9
RPIPKPAPWAPQKPRRQITNDFEGVPSSPTTPPSECDSVPWTVLTEGSTLHLTAQT

SEQ ID NO: 5472 - protein, 56 aa, Alphapapillomavirus 9
KAVALGTEETQTTIQRPRSEPDTGNPCHTTKLLHRDSVDSAPILTAFNSSHKGRIN

SEQ ID NO: 5473 - protein, 54 aa, Alphapapillomavirus 9
ENGNPVYELNDKNWKSFFSRTWSRLSLHEDEDKENDGDSLPTFKCVSGQNTNTL

SEQ ID NO: 5474 - protein, 56 aa, Alphapapillomavirus 9
ANGNPVYKINDENWKSFFSRTWCKLGLIEEEDKENDGGNISTFKCSAGQNPRHIRS

SEQ ID NO: 5475 - protein, 56 aa, Alphapapillomavirus 9
RPIPKPSPWAPKKHRRLSSDQDQSQTPETPATPLSCCTETQWTVLQSSLHLTAHTK

SEQ ID NO: 5476 - protein, 56 aa, Alphapapillomavirus 9
DANGNPVYKINDENWKSFFSRTWCKLGLIEEEDKENDGGNISTFKCSAGQNPRHIR

SEQ ID NO: 5477 - protein, 49 aa, Alphapapillomavirus 9
GLNDKNWKSFFSRTWCRLNLHEEEDKENDGDAFPAFKCVSGQNTRTLRD

SEQ ID NO: 5478 - protein, 56 aa, Alphapapillomavirus 9
ENGNPVYAINDENWKSFFSRTWCKLDLIEEEDKENHGGNISTFKCSAGENTRSLRS

SEQ ID NO: 5479 - protein, 56 aa, Alphapapillomavirus 9
TLKTRSGKQIGARIHYYQDLSPIVPLDHTVPNEQYELQPLHDTSTSSYSINDGLYD

SEQ ID NO: 5480 - protein, 56 aa, Alphapapillomavirus 9
FPDTSFYDPASQRLVWACTGVEVGRGQPLGVGISGHPLLNKLDDTENSNKYVGNSG

SEQ ID NO: 5481 - protein, 56 aa, Alphapapillomavirus 9
QQMADQVDGQNGDWQSNSSQSSGVGASNSDVSCTSIEDNEENSNRTLKSIQNIMCE

SEQ ID NO: 5482 - protein, 56 aa, Alphapapillomavirus 9
TSTIRPPVTVEPIGPLEPSIVSMIEETTFIESGAPAPSIPSATGFDVTTSANNTPA

SEQ ID NO: 5483 - protein, 56 aa, Alphapapillomavirus 9
TVPNEQYELQPLHDTSTSSYSINDGLYDVYADDVDNVHTPMQHSYSTFATTRTSNV

SEQ ID NO: 5484 - protein, 16 aa, Alphapapillomavirus 9
MRHKRSTRRKRASATQ

SEQ ID NO: 5485 - protein, 56 aa, Alphapapillomavirus 9
PFDENGNPIYEINNENWKSFFSRTWCKLDLIQEEDKENDGVDTGTFKCSAGKNTRS

SEQ ID NO: 5486 - protein, 56 aa, Alphapapillomavirus 9
LGVGISGHPLLNKLDDTENSNKYVGNSGTDNRECISMDYKQTQLCLIGCRPPIGEH

SEQ ID NO: 5487 - protein, 56 aa, Alphapapillomavirus 9
PKTTEATNNESTQGTKRRRLDLPDSRDNTQYSTKYTDCAVDSRPRGGGLHSTTNCT

SEQ ID NO: 5488 - protein, 56 aa, Alphapapillomavirus 9
MEDPEGTEGEREGCTGWFEVEAIIEKQTGDNISEDEDENAYDSGTDLIDFIDDSNI

SEQ ID NO: 5489 - protein, 56 aa, Alphapapillomavirus 9
PHRIPKPAPWAPVKVCGGRRRLLSDQEQSQSTETPTTPTSCCEATPWTVSTVGLSV

SEQ ID NO: 5490 - protein, 56 aa, Alphapapillomavirus 9
EDWNFGLQPPPGGTLEDTYRFVTQAIACQKHTPPAPKEDDPLKKYTFWEVNLKEKF

SEQ ID NO: 5491 - protein, 48 aa, Alphapapillomavirus 9
LNDENWKSFFSRTWCQLDLIEEEDKENHGGNCNTFKCSAGENSRCIRS

SEQ ID NO: 5492 - protein, 56 aa, Alphapapillomavirus 9
MADPEATKYPLLKLLTYRQTTITDHHKQRPNDDDLQTPQTPPSPLQSCSVQTPPWT

SEQ ID NO: 5493 - protein, 46 aa, Betapapillomavirus 1
LTDQSWKSFFTRLWTQLDLSDQEEEGEDGESQRAFQCSARSANEHL

SEQ ID NO: 5494 - protein, 56 aa, Betapapillomavirus 1
MIGKEVTVQDIVLELSEVQPEVLPVDLFCEEELPNEDTEEELDTERIVFKVIAPCG

SEQ ID NO: 5495 - protein, 46 aa, Betapapillomavirus 1
DQSWKSFFERLWTQLELSDQEEEEEGEHGETQRAFQCSARSANEHI

SEQ ID NO: 5496 - protein, 35 aa, Betapapillomavirus 1
RMLISFSSDGQRKHFDETVKYPKGVETSYGNLDSL

SEQ ID NO: 5497 - protein, 56 aa, Betapapillomavirus 1
PTPPTRVRVSRTQYHNPSFQIITDSTPTQGESSLADHILVTSGSGGQTIGSDITDV

SEQ ID NO: 5498 - protein, 47 aa, Betapapillomavirus 1
PESRDKIELIYPSPTLPAVVIHTEDSSGDFYLHPSLLQRRRRKRKYL

SEQ ID NO: 5499 - protein, 43 aa, Betapapillomavirus 1
QSWKSFFARLWTQLELSDQEDEGEHGESQRAFQCSARSANEHL

SEQ ID NO: 5500 - protein, 56 aa, Betapapillomavirus 1
SSTSPTPTKRSRGESSRLRGVSPSEVGRSVQSVSAKHTGRLGRLLDEAIDPPVILV

SEQ ID NO: 5501 - protein, 56 aa, Betapapillomavirus 1
GRAAAPLKLDLDPPQGGPDQPPGATGGVGETPPEGNEESQPPPGEGEGAVEGHPPP

SEQ ID NO: 5502 - protein, 56 aa, Betapapillomavirus 1
FEQDVDTFEEPPDRDFLDIRKLGRPQYSTTPAGYVRVSRLGTRATIRTRSGAQIGS

SEQ ID NO: 5503 - protein, 56 aa, Betapapillomavirus 1
PVAEGPSVDTPVVTTSTGSSAVLEVAPEPIPPTRVRISRTQYHNPSFQIITESTPA

SEQ ID NO: 5504 - protein, 44 aa, Betapapillomavirus 1
DQSWKSFFERLWTQLELSDQEDEGENGESQRAFQCSAGSANEHL

SEQ ID NO: 5505 - protein, 56 aa, Betapapillomavirus 1
YVVFADDARRYSATGEWEVKINKDTVFAPVTSSTPPGSPPGQADTDTAAKTPTTSA

SEQ ID NO: 5506 - protein, 56 aa, Betapapillomavirus 1
QPVPPLAVSEGKAKEAIGIMLQLQSLQKSEYASEPWTLVDTSAETYRNAPEQHFKK

SEQ ID NO: 5507 - protein, 56 aa, Betapapillomavirus 1
PVPPTRVRIARTQYHNPSFQILTESTPAQGESSLADHILVTSGSGGQRIGGDITDE

SEQ ID NO: 5508 - protein, 56 aa, Betapapillomavirus 1
VSPSEVGKQLRSVGAKHSGRLGRLLEEARDPPVILVRGDANTLKCFRNRARNKYRG

SEQ ID NO: 5509 - protein, 56 aa, Betapapillomavirus 1
PIPEGPTIDSPVVTTTTGSSAVLEVAPEPVPPTRVRIARTQYHNPSFQILTESTPA

SEQ ID NO: 5510 - protein, 56 aa, Betapapillomavirus 1
QPVPTLAVSEAKAKEAIGIMLQLQSLQKSEYASENWTLVDTSAETYNNVPEHHFKK

SEQ ID NO: 5511 - protein, 56 aa, Human coronavirus HKU1
DVVTGDNDDEDVVTGDNDDEDVVTGDNDDEDVVTGDNDDEDVVTGDNDDEDVVTGD

SEQ ID NO: 5512 - protein, 56 aa, Human coronavirus HKU1
VTGDNDDEDVVTGDNDDEDVVTGDNDDEDVVTGDNDDEDVVTGDNDDEDVVTGDND

SEQ ID NO: 5513 - protein, 56 aa, Human coronavirus HKU1
DVISSEAVEDTIDGVVEDTINDDEDVVTGDNDDEDVVTGDNDDEDVVTGDNDDEDV

SEQ ID NO: 5514 - protein, 56 aa, Human coronavirus HKU1
YSVSSCDLRMGSGFCIDYALPSSRRKRRGISSPYRFVTFEPFNVSFVNDSVETVGG

SEQ ID NO: 5515 - protein, 56 aa, Human coronavirus HKU1
GDNDDEDVVTGDNDDEDVVTGDNDDEDVVTGDNDDEDVVTGDNDDEDVVTGDNDDD

SEQ ID NO: 5516 - protein, 56 aa, Human coronavirus HKU1
GDNDDEDVVTGDNDDEDVVTGDNDDEDVVTGDNDDEDVVTGDNDDEDVVTGDNDDE

SEQ ID NO: 5517 - protein, 56 aa, Human coronavirus HKU1
DEDVVTGDNDDEDVVTGDNDDEDVVTGDNDDEHVVTGDNDDEDVVTGDNDDEDVVT

SEQ ID NO: 5518 - protein, 56 aa, Human coronavirus HKU1; identical to SEQ ID NO: 5516

SEQ ID NO: 5519 - protein, 56 aa, Human coronavirus HKU1
DYSVSSCALRMGSGFCVDYNSPSSSSSRRKRRSISASYRFVTFEPFNVSFVNDSIE

SEQ ID NO: 5520 - protein, 56 aa, Human coronavirus HKU1
GVCVNYDLYGITGQGIFKEVSAAYYNNWQNLLYDSNGNIIGFKDFLTNKTYTILPC

SEQ ID NO: 5521 - protein, 56 aa, Human coronavirus HKU1; identical to SEQ ID NO: 5513

SEQ ID NO: 5522 - protein, 56 aa, Human coronavirus HKU1; identical to SEQ ID NO: 5516

SEQ ID NO: 5523 - protein, 56 aa, Human coronavirus HKU1; identical to SEQ ID NO: 5512

SEQ ID NO: 5524 - protein, 56 aa, Human coronavirus HKU1; identical to SEQ ID NO: 5511

SEQ ID NO: 5525 - protein, 56 aa, Human coronavirus HKU1
VTGDNDDEDVVTGDNDDEDVVTGDNDDEDVVTGDNDDEDVVTGDNNDEDVVTGDNN

SEQ ID NO: 5526 - protein, 56 aa, Human coronavirus HKU1
RKRRSISASYRFVTFEPFNVSFVNDSIESVGGLYEIKIPTNFTIVGQEEFIQTNSP

SEQ ID NO: 5527 - protein, 56 aa, Human coronavirus HKU1
GDNDDEHVVTGDNDDEHVVTGDNDDEDVVTGDNDDEDVVTGDNDDEDVVTGDNDDE

SEQ ID NO: 5528 - protein, 56 aa, Human coronavirus HKU1; identical to SEQ ID NO: 5513

SEQ ID NO: 5529 - protein, 56 aa, Human coronavirus HKU1
NDDEHVVTGDNDDEDVVTGDNDDEDVVTGDNDDEDVVTGDNDDEDVVTGDNDDEDV

SEQ ID NO: 5530 - protein, 56 aa, Human coronavirus HKU1; identical to SEQ ID NO: 5512

SEQ ID NO: 5531 - protein, 56 aa, Human coronavirus HKU1
DEDVVTGDNDDEDVVTGDNDDEEIVTGDNDDQIVVTGDDVDDIESVYDFDTYKALL

SEQ ID NO: 5532 - protein, 56 aa, Human coronavirus HKU1
DVVTGDNDDEDVVTGDNDDEDVVTGDNDDEDVVTGDNDDEDVVTGDNDDEEIVTGD

SEQ ID NO: 5533 - protein, 56 aa, Human coronavirus HKU1
DVISSEVVEDTIDGVVEDTINDDEDVVTGDNDDEHVVTGDNDDEHVVTGDNDDEDV

SEQ ID NO: 5534 - protein, 56 aa, Human coronavirus HKU1
EAIPTRFPPGTILPQGYYVEGSGRSASNSRPGSRSQSRGPNNRSLSRSNSNFRHSD

SEQ ID NO: 5535 - protein, 56 aa, Human coronavirus HKU1
LEGVFWVANHQADTSTPSDVSSRDPTTQEAIPTRFPPGTILPQGYYVEGSGRSASN

SEQ ID NO: 5536 - protein, 56 aa, Human coronavirus HKU1
NDDEDVVTGDNDDEDVVTGDNNDEEIVTGDNDDQIVVTGDDVDDIESIYDFDTYKA

SEQ ID NO: 5537 - protein, 56 aa, Human coronavirus HKU1
DEDVVTGDNDDEDVVTGDNDDEDVVTGDNDDEDVVTGDNDDEDVVTGDNNDEEIVT

SEQ ID NO: 5538 - protein, 56 aa, Human coronavirus HKU1
DVVTGDNDDEDVVTGDNNDEDVVTGDNNDEESVTGDNDDQIVVTGDDVDDIESIYD

SEQ ID NO: 5539 - protein, 56 aa, Human coronavirus HKU1
VTGDNDDEDVVTGDNDDEDVVTGDNDDDNDDQIVVIGDDVDDIDTINCESIYEFDT

SEQ ID NO: 5540 - protein, 56 aa, Human coronavirus HKU1
YKVNCCRFQRIDDDGNKLDKFFVVKRTNLEVYNKEKTYYELTKSCGVVAEHDFFTF

SEQ ID NO: 5541 - protein, 56 aa, Human coronavirus HKU1
CKYTDLNFIENLNVLFDGRDNGALEAFRKARNGVFISTGKLSSLSMIKGPQRADLN

SEQ ID NO: 5542 - protein, 56 aa, Human adenovirus E
DVYPTMQLMVPKRQKLEDVLETMKVDPDAQPEVKVRPIKQVAPGLGVQTVDIKIPT

SEQ ID NO: 5543 - protein, 56 aa, Human adenovirus E
AQPEVKVRPIKQVAPGLGVQTVDIKIPTEPMETQTEVVKPITSTMEVQTDPWMPVV

SEQ ID NO: 5544 - protein, 56 aa, Human adenovirus E
DLYPTMQLMVPKRQKLEDVLEHMKVDPEVQPEVKVRPIKQVAPGLGVQTVDIKIPT

SEQ ID NO: 5545 - protein, 56 aa, Human adenovirus E
MGDDHPEPPTPFETPSLHDLYDLEVDVPEDDPNEKAVNDLFSDAALLAAEEASSPS

SEQ ID NO: 5546 - protein, 56 aa, Human adenovirus E
PPLDKRGDKRPRPDAEETLLTHTDEPPPYEEAVKLGLPTTRPIAPLATGVLKPESS

SEQ ID NO: 5547 - protein, 56 aa, Human adenovirus E
MGDDHPEPPTPFETPSLHDLYDLEVDVPEDDPNEEAVNDLFSDAALLAAEEALSPR

SEQ ID NO: 5548 - protein, 56 aa, Human adenovirus E
AILEAVVPSRSNPTHEKVLAIVNALVENKAIRGDEAGLVYNALLERVARYNSTNVQ

SEQ ID NO: 5549 - protein, 56 aa, Human adenovirus E
ELGRITRPRLLGEEEYLNNSLLRPEREKNFPNNGIESLVDKMNRWKTYAQEHRDDP

SEQ ID NO: 5550 - protein, 56 aa, Human adenovirus E; identical to SEQ ID NO: 5545

SEQ ID NO: 5551 - protein, 56 aa, Human adenovirus E
NFPNNGIESLVDKMNRWKTYAQEHRDDPRATQGTASRGSAARKRRWHDRQRGLMWD

SEQ ID NO: 5552 - protein, 56 aa, Human adenovirus E
PTPSLKPVTLQQVLPNAAPRQGFKRQGEDVYPTMQLMVPKRQKLEDVLETMKVDPD

SEQ ID NO: 5553 - protein, 56 aa, Human adenovirus E
MRHLRDLPDEEIIIASGSEILELVVNATMGDDHPEPPTPFGTPSLHDLYDLEVDVP

SEQ ID NO: 5554 - protein, 56 aa, Human adenovirus E
QPPLEAPYVPPRYLAPTEGRNSIRYSELTPLYDTTRLYLVDNKSADIASLNYQNDH

SEQ ID NO: 5555 - protein, 56 aa, Human adenovirus E
MRHLRDLPDEEIIIASGSEILELVVNAMMGDDHPEPPTPFETPSLHDLYDLEVDVP

SEQ ID NO: 5556 - protein, 56 aa, Human adenovirus E
AVQRQINSRLDPDPPAGSVEMPQVEEELPPLDKRGDKRPRPDAEETLLTHTDEPPP

SEQ ID NO: 5557 - protein, 56 aa, Human adenovirus E
EEEVEEAAAARPSSSAGEKASSTDTISAPGRGPARPHSRWDETGRFPNPTTQTAPT

SEQ ID NO: 5558 - protein, 56 aa, Human adenovirus E
PPPGFYTGEYDMPDPNDGFLWDDVDSSVFSPRPGANERPLWKKEGSDRRPSSTLSG

SEQ ID NO: 5559 - protein, 56 aa, Human adenovirus E
MPRGSSKKLKVELPPPPEDLEEDWESSQAEEEEMEDWDSTQAEEDSLQDSLEEEDE

SEQ ID NO: 5560 - protein, 56 aa, Human adenovirus E
KLKEQNFQQKVVDGLASGINGVVDLANQAVQRQINSRLDPDPPAGSVEMPQVEEEL

SEQ ID NO: 5561 - protein, 56 aa, Human adenovirus E
APRRRVQWRGRKVKPVLRPGTTVVFTPGERSGSASKRSYDEVYGDEDILEQAAERL

SEQ ID NO: 5562 - protein, 56 aa, Human adenovirus E
TPSLKPVTLQQVLPGAAPRRGFKREGGEDLYPTMQLMVPKRQKLEDVLEHMKVDPE

SEQ ID NO: 5563 - protein, 56 aa, Human adenovirus E
VQPEVKVRPIKQVAPGLGVQTVDIKIPTEPMETQTEPVKPSTSTMEVQTDPWMPAP

SEQ ID NO: 5564 - protein, 56 aa, Human adenovirus E
MRHLRDLPDEKIIIASGSEILELVVNAIMGDDHPEPPTPFETPSLHDLYDLEVDVP

SEQ ID NO: 5565 - protein, 52 aa, Influenza C virus
FDPDYNPIRVKRPKKPIAKRNSNISRLEEEGMDENSEIGQAKKMKPLDQLAK

SEQ ID NO: 5566 - protein, 56 aa, Influenza C virus
NYFQVIYDSSGKVVGGLDNRVSPYTGNSGDTPTMQCDMLQLKPGRYSVRSSPRFLL

SEQ ID NO: 5567 - protein, 56 aa, Influenza C virus
MPERSYCFDMKEKGPVTAVQSIWGKGRKSDYAVDQACLSTPGCMLIQKQKPYIGEA

SEQ ID NO: 5568 - protein, 56 aa, Influenza C virus
FDPDYNPIRVKRPKKPIAKRNSNISRLEEEGMDENSEIGQAKKMKPLDQLTSTSSN

SEQ ID NO: 5569 - protein, 56 aa, Influenza C virus
FDMKEKGPVTAVQSIWGKNRKSDYAVDQACLSTPGCMLIQKQKPYTGEADDHHGDQ

SEQ ID NO: 5570 - protein, 56 aa, Influenza C virus
MKTSTKARLRTESSFAPRTWEDAIKDGELLFNGTILQAESPTMTPASVEMRGKKLP

SEQ ID NO: 5571 - protein, 56 aa, Influenza C virus
MKTSTKARLRTESSFAPRTWEDAIKDGELLFNGTILQAESPTMTPASVEMKGKKIP

SEQ ID NO: 5572 - protein, 56 aa, Influenza C virus
TMEGVLQGTNCAREMGKCILTVGALMTECRLFPGKIKVVPIYARSKERKSMQEGLP

SEQ ID NO: 5573 - protein, 56 aa, Influenza C virus
SLKKSEGRDIRKQMKAAGDFLGVESMMKMRAFRDDQIMEMVEEVYDHPDDYTPDIR

SEQ ID NO: 5574 - protein, 56 aa, Influenza C virus
KEKGPVTAVQSIWGKGRKSDYAVDQACLSTPGCMLIQKQKPYIGEADDHHGDQEMR

SEQ ID NO: 5575 - protein, 56 aa, Influenza C virus
TSRKEKNPSLRMRWAMSSKFPIIANKRMLEEAQIPKEHNNVALWEDTEDVSKRDHV

SEQ ID NO: 5576 - protein, 56 aa, Influenza C virus
MSDKTVKSTNLMAFVATKMLERQEDLDTCTEMQVEKMKTSTKARLKTESSFAPRTW

SEQ ID NO: 5577 - protein, 56 aa, Influenza C virus
FDPDYNPIRVKRPKKPIAKRNSNISRLEEEGMDENSEIGQAKKMKPLDQLASTSSN

SEQ ID NO: 5578 - protein, 56 aa, Influenza C virus
SLKKSEGRDIRKQMKAAGDFLGVESMMKMRAFRDDQIMEMVEEVYDHPNDYTPDIR

SEQ ID NO: 5579 - protein, 56 aa, Influenza C virus; identical to SEQ ID NO: 5573

SEQ ID NO: 5580 - protein, 49 aa, Influenza C virus
KEKGPVTAVQSIWGKGRKSDYAVDQACLSTPGCMLIQKQKPYVGEADDH

SEQ ID NO: 5581 - protein, 56 aa, Influenza C virus
IQKQKPYVGEADDHHGDQEMRELLSGLDYEARCISQSGWVNETSPFAEEYLLPPKF

SEQ ID NO: 5582 - protein, 56 aa, Influenza C virus
MSDKTVKSTNLMAFVATKMLERQKDLDTCTEMQVEKMKTSTKARLRTESSFAPRTW

SEQ ID NO: 5583 - protein, 56 aa, Influenza C virus
YPEIKPWKKASDMLNKATSSLKKSEGRDIRKQMKAAGDFLGVESMMKMRAFRDDQI

SEQ ID NO: 5584 - protein, 56 aa, Influenza C virus
MSDKTVKSTNLMAFVATKMLERQEDLDTCTEMQVEKMKTSTKARLRTESSFAPRTW

SEQ ID NO: 5585 - protein, 56 aa, Influenza C virus; identical to SEQ ID NO: 5576

SEQ ID NO: 5586 - protein, 56 aa, Influenza C virus
ITNRAGDLAVEVSPGCWIIDNNICDQSCQNFIFKFNETAPVPTIPPLDTKIDLQSD

SEQ ID NO: 5587 - protein, 56 aa, Influenza C virus
MSDKTVKSTNLMAFIATKMLERQEDLDTCTEMQVEKMKTSTKARLRTESSFAPRTW

SEQ ID NO: 5588 - protein, 49 aa, Influenza C virus
KEKGPVTAVQSIWGKGRKSDYAVDQACLSTPGCMLIQKQKPYIGEADDH

SEQ ID NO: 5589 - protein, 56 aa, Human parvovirus B19
KVTGTDLELIQILKDHYNISLDNPLENPSSLFDLVARIKNNLKNSPDLYSHHFQSH

SEQ ID NO: 5590 - protein, 50 aa, Human parvovirus B19
GPGNELQAGPPQSAVDSAARIHDFRYSQLAKLGINPYTHWTVADEELLKN

SEQ ID NO: 5591 - protein, 56 aa, Human parvovirus B19
PEHHYKVFSPAASSCHNASGKEAKVCTISPIMGYSTPWRYLDFNALNLFFSPLEFQ

SEQ ID NO: 5592 - protein, 56 aa, Human parvovirus B19; identical to SEQ ID NO: 5589

SEQ ID NO: 5593 - protein, 56 aa, Human parvovirus B19
SEGATFSANSVTCTFSRQFLIPYDPEHHYKVFSPAASSCHNASGKEAKVCTISPIM

SEQ ID NO: 5594 - protein, 56 aa, Human parvovirus B19
SAARIHDFRYSQLAKLGINPYTHWTVADEELLKNIKNETGFQAQVVKDYFTLKGAA

SEQ ID NO: 5595 - protein, 56 aa, Human parvovirus B19
QVSVQLPGTNYVGPGNELQAGPPQSAVDSAARIHDFRYSQLAKLGINPYTHWTVAD

SEQ ID NO: 5596 - protein, 56 aa, Human parvovirus B19
LGTGGTASMSYKFPPVPPENLEGCSQHFYEMYNPLYGSRLGVPDTLGGDPKFRSLT

SEQ ID NO: 5597 - protein, 56 aa, Human parvovirus B19
YEMYNPLYGSRLGVPDTLGGDPKFRSLTHEDHAIQPQNFMPGPLVNSVSTKEGDSS

SEQ ID NO: 5598 - protein, 56 aa, Human parvovirus B19
EGATFSANSVTCTFSRQFLIPYDPEHHYKVFSPAASSCHNASGKEAKVCTISPIMG

SEQ ID NO: 5599 - protein, 56 aa, Human parvovirus B19
AGPPQSAVDSAARIHDFRYSQLAKLGINPYTHWTVADEELLKNIKNETGFQAQVVK

SEQ ID NO: 5600 - protein, 56 aa, Human parvovirus B19
MSKKSGKWWESDDKFAKAVYQQFVEFYEKVTGTDLELIQILKDHYNISLDNPLENP

SEQ ID NO: 5601 - protein, 56 aa, Human parvovirus B19
FDFPGINADALHPDLQTVPIVADTSVSSSGGESSEELSESSFFNLITPGAWNSETP

SEQ ID NO: 5602 - protein, 56 aa, Human parvovirus B19
YNPLYGSRLGVPDTLGGDPKFRSLTHEDHAIQPQNFMPGPLVNSVSTKEGDSSNTG

SEQ ID NO: 5603 - protein, 56 aa, Human parvovirus B19
KSMWSEGATFSANSVTCTFSRQFLIPYDPEHHYKVFSPAASSCHNASGKEAKVCTI

SEQ ID NO: 5604 - protein, 50 aa, Human parvovirus B19
KVFSPAASSCHNASGKEAKVCTISPIMGYSTPWRYLDFNALNLFFSPLEF

SEQ ID NO: 5605 - protein, 56 aa, Human parvovirus B19
LHPDLQTVPIVADTSVSSSGGESSEELSESSFFNLITPGAWNSETPRSSTPVPGTS

SEQ ID NO: 5606 - protein, 56 aa, Human parvovirus B19
FRRGACHAKKPRITTAINDTSSDAGESSGTGAEVVPFNGKGTKASIKFQTMVNWLC

SEQ ID NO: 5607 - protein, 56 aa, Human parvovirus B19
PPQSAVDSAARIHDFRYSQLAKLGINPYTHWTVADEELLKNIKNETGFQAQVVKDY

SEQ ID NO: 5608 - protein, 47 aa, Human parainfluenza virus 4
PEISHQTPTIRMNRNVNIRDSTRDDRQDANEDRSSNIPDDILGDLDN

SEQ ID NO: 5609 - protein, 56 aa, Human parainfluenza virus 4
MKIMDPGVPSKVSLRSLNKESEQVPIIVTGNGDVSKFVDQDNTITLDSLARPILSG

SEQ ID NO: 5610 - protein, 56 aa, Human parainfluenza virus 4
TQNTIQQTKNDTQQIKGSLATIEGLITTMKIMDPGVPSKVSLRSLNKGPEQVPIIV

SEQ ID NO: 5611 - protein, 56 aa, Human parainfluenza virus 4
GIDQDETRDTLPESTMHRFQNIDSTNSDHNELQMPEFENDINPFNHPRFTARAPLI

SEQ ID NO: 5612 - protein, 56 aa, Human parainfluenza virus 4
MKIMDPGVPSKVSLRSLNKGPEQVPIIVTGTGDVSKFVDQDNTITLDPLARPILSG

SEQ ID NO: 5613 - protein, 56 aa, Human parainfluenza virus 4
HNELQMPEFENDINPFNHPRFTARAPLIPEISHQTPTIRMNRNVNIRDSTRDDRQD

SEQ ID NO: 5614 - protein, 56 aa, Human parainfluenza virus 4
TQNTIQQTKNDTQQIKGSLATIEGLITTMKIMDPGVPSKVSLRSLNKESEQVPIIV

SEQ ID NO: 5615 - protein, 46 aa, Human parainfluenza virus 4
YSALVDHPDVIYRKIRIDPAKKQYAHSKWNPFKKAISMPNLTDDSI

SEQ ID NO: 5616 - protein, 38 aa, Alphapapillomavirus 10
QKPTPEKEKQDPYKDMSFWEVNLKEKFSSELDQFPLGR

SEQ ID NO: 5617 - protein, 55 aa, Alphapapillomavirus 10
FDRNGNALYDLCETNWKCFFARLSSSLDIQTSEDEDDGDNSQAFRCVPGTVVRTV

SEQ ID NO: 5618 - protein, 56 aa, Alphapapillomavirus 10
PGILEQWNFGLSPPPNGTLEDKYRYVQSQAITCQKPPPEKAKQDPYAKLSFWEVDL

SEQ ID NO: 5619 - protein, 56 aa, Alphapapillomavirus 10
QAITCQKPPPEKAKQDPYAKLSFWEVDLREKFSSELDQYPLGRKFLLQTGVQARSS

SEQ ID NO: 5620 - protein, 56 aa, Alphapapillomavirus 10
AITCQKPTPEKEKQDPYKDMSFWEVNLKEKFSSELDQFPLGRKFLLQSGYRGRTSA

SEQ ID NO: 5621 - protein, 56 aa, Alphapapillomavirus 10
ASVSSTVREVSIAEPTTYTPAQTTAPTVSACTTEDGVSAPPRKRARGPSTNNTLCV

SEQ ID NO: 5622 - protein, 56 aa, Rotavirus A
IDKLTTREIEQVELLKRIHDNLITRTVDVIDMSKEFNQKNIKTLDEWESGKNPYEP

SEQ ID NO: 5623 - protein, 56 aa, Rotavirus A
IDKLTTREIEQVELLKRIHDNLIIKPVDVIDMSKEFNQKNIKTLDEWESGKNPYEP

SEQ ID NO: 5624 - protein, 35 aa, Rotavirus A
EIDMTKEINQKNMKTLEEWESGRNPYEPKEVTAAM

SEQ ID NO: 5625 - protein, 56 aa, Rotavirus A
IDRLTTREIEQVELLKRIHDKLMVQSTGEIDMRKEINQKNVKTLEEWESGRNPYEP

SEQ ID NO: 5626 - protein, 35 aa, Rotavirus A
EIDMSKEINQKNVRTLDEWENGKNPYEPSEVTASL

SEQ ID NO: 5627 - protein, 35 aa, Rotavirus A
VIDMSKEFNQKNIKTLDEWESGKNPYEPLEVTASM

SEQ ID NO: 5628 - protein, 56 aa, Rotavirus A
VERKLVKYARSKPLEADLTVNELDYENNKITSELFPTEEEYTDSLMDPAILTSLSS

SEQ ID NO: 5629 - protein, 56 aa, Rotavirus A
GIKSTIDAAKSMATNVMKKFKKSGLATSVSTLTDSLSDAASSISRGSSIRSIGSSA

SEQ ID NO: 5630 - protein, 56 aa, Rotavirus A
VERKLVKYAKGKPLEADLTVNELDYENNKMTSELFPTAEEYTDSLMDPAILTSLSS

SEQ ID NO: 5631 - protein, 56 aa, Rotavirus A
PPIQNTRNIVPVSISSRSIIHQRAQANEDIIVSKTSLWKEMKYNRDITIRFKFANA

SEQ ID NO: 5632 - protein, 56 aa, Rotavirus A
LINKQKQSLITVRINNTFKDEPKVSFKNIYDWTFLPTDFELKDSVITSYDGCLGMF

SEQ ID NO: 5633 - protein, 56 aa, Rotavirus A
VERKLINYAKGKPLEADLTVNELDYENNKITSELFQSAEEYTDSLMDPAILTSLSS

SEQ ID NO: 5634 - protein, 46 aa, Rotavirus A
IHDNLITRPIDIVDMTKEFNQKNIKTLDEWENGKNPYEPIEVTASM

SEQ ID NO: 5635 - protein, 35 aa, Rotavirus A
VIDMSKEFNQKNIKTLDEWESGKNPYEPSEVTASM

SEQ ID NO: 5636 - protein, 56 aa, Rotavirus A
IDKLTTREIEQVELLKRIHDNLITRPVDVIDMSKEFNQKNIKTLDEWESGKNPYEP

SEQ ID NO: 5637 - protein, 35 aa, Rotavirus A
EIDMRKEINQKNVKTLEEWESGRNPYEPKEVTAAM

SEQ ID NO: 5638 - protein, 56 aa, Rotavirus A
SGVKNNLMGKAATIDQALNGKFSSSIRNRNWMTDSKTDARLDEDVNKLRLLLSSKG

SEQ ID NO: 5639 - protein, 56 aa, Rotavirus A
VERKLVSYAKGKPLEADLTANELDYENNKITSELFQSAEEYTDSLMDPAILTSLSS

SEQ ID NO: 5640 - protein, 56 aa, Ross River virus
SKDLYANTALKLSRPSSGTVHVPYTQTPSGFKYWIKERGTSLNDKAPFGCVIKTNP

SEQ ID NO: 5641 - protein, 56 aa, Ross River virus
RVRKVATEPPSEPEAPIPAPRKRRTTSTTPPHNPGDFVPRVPVELPWEPEDLDIQF

SEQ ID NO: 5642 - protein, 56 aa, Ross River virus
LSRPSPGVVHVPYTPTPSGFKYWLKEKGSSLNTKAPFGCKIKTNPVRAMDCAVGSI

SEQ ID NO: 5643 - protein, 56 aa, Ross River virus
GSGQPGRFGDIQSRTVESKDLYANTALKLSRPSPGVVHVPYTPTPSGFKYWLKEKG

SEQ ID NO: 5644 - protein, 56 aa, Ross River virus
HFNVYKATKPYLAYCADCGDGQFCYSPVAIEKIRDEASDGMIKIQVAAQIGINKRG

SEQ ID NO: 5645 - protein, 56 aa, Ross River virus
LSRPSPGVVHVPYTQTPSGFKYWLKEKGSSLNTKAPFGCKIKTNPVRAMDCAVGSI

SEQ ID NO: 5646 - protein, 56 aa, Ross River virus
VMERVATTDIRAIPVPARRAITMPVPAPRVRKVATEPPSEPEAPIPAPRKRRTTST

SEQ ID NO: 5647 - protein, 56 aa, Ross River virus
VDRPGYYDLLEATMTCNNSARHRRSVTEHFNVYKATKPYLAYCADCGDGQFCYSPV

SEQ ID NO: 5648 - protein, 56 aa, Ross River virus
PVYDTAVVAERVAIPCTSEYATPIPTPRAVRVVPVPAPRIQRASTYRVSPTPTPRV

SEQ ID NO: 5649 - protein, 56 aa, Ross River virus
PVAIEKIRDEASDGMLKIQVSAQIGLDKAGTHAHTKMRYMAGHDVQESKRDSLRVY

SEQ ID NO: 5650 - protein, 56 aa, Ross River virus
ALSESATMVYNEREFINRKLHHIALYGPALNTDEENYEKVRAERAEAEYVFDVDKR

SEQ ID NO: 5651 - protein, 56 aa, Ross River virus
GSGQPGRFGDIQSRTVESKDLYANTALKLSRPSPGVVHVPYTQTPSGFKYWLKEKG

SEQ ID NO: 5652 - protein, 56 aa, Ross River virus
NDVYNQDFPPYGSGQPGRFGDIQSRTVESKDLYANTALKLSRPSSGTVHVPYTQTP

SEQ ID NO: 5653 - protein, 56 aa, Rubella virus
AAPPAPPQAPRAHGKHYGHHHHQLPFLGHDGHHGGTLRVGQHHRNASDVLPGHWLQ

SEQ ID NO: 5654 - protein, 56 aa, Rubella virus
AAPPTLPQPPRAHGQHYGHHHHQLPFLGHDGHHGGTLRVGQHHRNASDVLPGHWLQ

SEQ ID NO: 5655 - protein, 56 aa, Rubella virus
AAPPMPPQPPRAHGQHYGHHHHQLPFLGHDGHHGGTLRVGQHHRNASDVLPGHWLQ

SEQ ID NO: 5656 - protein, 56 aa, Rubella virus
AAPPTLPQPPCAHGQHYGHHHHQLPFLGHDGHHGGTLRVGQHYRNASDVLPGHWLQ

SEQ ID NO: 5657 - protein, 56 aa, Rubella virus
AAPPAPPQPPCAHGQHYGHHHHQLPFLGHDGHHGGTLRVGQHHRNASDVLPGHCLQ

SEQ ID NO: 5658 - protein, 56 aa, Rubella virus
MNYTGNQQSRWGLGSPNCHGPDWASPVCQRHSPDCSRLVGATPERPRLRLVDADDP

SEQ ID NO: 5659 - protein, 56 aa, Rubella virus
MASTTPITMEDLQKALEAQSRALRAELAAGASQPRRPRPPRQRDSSTSGDDSGRDS

SEQ ID NO: 5660 - protein, 56 aa, Rubella virus
EYIMNYTGNQQSRWGLGSPNCHGPDWASPVCQRHSPDCSRLVGATPERPRLRLVDA

SEQ ID NO: 5661 - protein, 56 aa, Rubella virus
TPHGQLEVQVPPDPGDLVEYIMNYTGNQQSRWGLGSPNCHGPDWASPVCQRHSPDC

SEQ ID NO: 5662 - protein, 56 aa, Rubella virus
AAPPTPPQPPRAHGQHYGHHHHQLPFLGHDGHHGGTLRVGQHHRNASDVLPGHWLQ

SEQ ID NO: 5663 - protein, 56 aa, Rubella virus
HPFCNTPHGQLEVQVPPDPGDLVEYIMNYTGYQQSRWGLGSPNCHGPDWASPVCQR

SEQ ID NO: 5664 - protein, 56 aa, Rubella virus
QSRWGLGSPNCHGPDWASPVCQRHSPDCSRLVGATPERPRLRLVDADDPLLRTAPG

SEQ ID NO: 5665 - protein, 56 aa, Rubella virus
MASTTPITMEDLQKALEAQSRALRAELAAGASQSRRPRPPRQRDSSTSGDDSGRDS

SEQ ID NO: 5666 - protein, 56 aa, Rubella virus
PQAFLAGLLLAAVAVGTARAGLQPRADMAAPPMPPQPPRAHGQHYGHHHHQLPFLG

SEQ ID NO: 5667 - protein, 56 aa, Rubella virus
MASTTPITMEDLQKALEAQSRALRAGLAAGASQSRRPRPPRQRDSSTSGDDSGRDS

SEQ ID NO: 5668 - protein, 56 aa, Rubella virus
PPRRARRSQRHSDARGTPPPAPARDPPPPAPSPPAPPRAGDPDSPTSAEPADRARH

SEQ ID NO: 5669 - protein, 56 aa, Human coronavirus NL63
NVQERWRMRRGQRVDLPPKVHFYYLGTGPHKDLKFRQRSDGVVWVAKEGAKTVNTS

SEQ ID NO: 5670 - protein, 41 aa, Human coronavirus NL63
EMQSQSSHVAQNTVLNASIPESKPLADDDSAIIEIVNEVLH

SEQ ID NO: 5671 - protein, 56 aa, Human coronavirus NL63
RQQSRTRSDSNQSSSDLVAAVTLALKNLGFDNQSKSPSSSGTSTPKKPNKPLSQPR

SEQ ID NO: 5672 - protein, 56 aa, Human coronavirus NL63
KKPNKPLSQPRADKPSQLKKPRWKRVPTREENVIQCFGPRDFNHNMGDSDLVQNGV

SEQ ID NO: 5673 - protein, 56 aa, Human coronavirus NL63
GFDNQSKSPSSSGTSTPKKPNKPLSQPRADKPSQLKKPRWKRVPTREENVIQCFGP

SEQ ID NO: 5674 - protein, 55 aa, Human coronavirus NL63
SDKAPYRVIPRNLVPIGKGNKDEQIGYWNVQERWRMRRGQRVDLPPKVHFYYLGT

SEQ ID NO: 5675 - protein, 56 aa, Human coronavirus NL63
DDSVTLALKNLGFDNQSKSPSSSGTSTPKKPNKPLSQPRADKPSQLKKPRWKRVPT

SEQ ID NO: 5676 - protein, 56 aa, Human coronavirus NL63
NKSAGWPLNKFGKASLYYESISYEEQDALFALTKRNVLPTMTQLNLKYAISGKERA

SEQ ID NO: 5677 - protein, 56 aa, Venezuelan equine encephalitis virus
SFVLPRIGSNTLEIGLRTRIRKMLEEHKEPSPLITAEDVQEAKCAADEAKEVREAE

SEQ ID NO: 5678 - protein, 56 aa, Venezuelan equine encephalitis virus
SFVLPRIGSNTLEIGLRTRIRKLLEEPVDRPPLITADDIQEAKNAADEAKEVKEAE

SEQ ID NO: 5679 - protein, 56 aa, Venezuelan equine encephalitis virus
DKKMKELAEVMSDPDLETETICLHDDETCRFEGQVAVYQDVYAVDGPTSLYHQANK

SEQ ID NO: 5680 - protein, 56 aa, Venezuelan equine encephalitis virus
SVSRTSLVSNPPGVNRVITREEFEAFVAQQQRFDAGAYIFSSDTGQGHLQQKSVRQ

SEQ ID NO: 5681 - protein, 56 aa, Torque teno virus
IFHQWDQRRGLFTKRSIKRMSEYSSDDENFSPGPSKRPALDTRPEGLAGEQRSAYA

SEQ ID NO: 5682 - protein, 56 aa, Torque teno virus
KPTHALPEPGTLPRILQVSDPARLGPKTIFHQWDQRRGLFTKRSIKRMSEYSSDDE

SEQ ID NO: 5683 - protein, 56 aa, Torque teno virus
DPRKVGIQFHPWDLRRGMLSTSSIKRMLQDSDDDESIEFPPKAWPGDPVPVGRTLE

SEQ ID NO: 5684 - protein, 56 aa, Torque teno virus
QIVNPKYLDPGITFHRWDLRRGFFGPAAVKRMQAESTDALFPTTGPKRPRTEVPVA

SEQ ID NO: 5685 - protein, 56 aa, Torque teno virus
PIFQQTVKDPCKQSTFDIPGAGGIPRPIQIVNPKYLDPGITFHRWDLRRGFFGPAA

SEQ ID NO: 5686 - protein, 56 aa, Torque teno virus
ERCSSSLYHLLQEQATPPPFKKPRTEDQEENPEETTQLQLFQELQRQRELQLQLKR

SEQ ID NO: 5687 - protein, 56 aa, Torque teno virus
QVGDPCKQPTHPLPAPGGGDLLRAVQVSDPRKVGIQFHPWDLRRGMLSTSSIKRML

SEQ ID NO: 5688 - protein, 51 aa, Torque teno virus
EENPEETTQLQLFQELQRQRELQLQLKRGFRGLVEEMIKSHRHLALDPYLK

SEQ ID NO: 5689 - protein, 44 aa, Torque teno virus
HQPPRRGGGAGGAGDGHAGDGDAAEEYGPEDLDLLFAAAAEDDM

SEQ ID NO: 5690 - protein, 22 aa, Hepatitis E virus
AHFTESIKPVLDLTNSILGRVE

SEQ ID NO: 5691 - protein, 56 aa, Hepatitis E virus
IDAVPPAPPDVALHQMAEAFGHRPLEVRAVVPPCPALEQGKLYTPFNMSGREQVTV

SEQ ID NO: 5692 - protein, 56 aa, Hepatitis E virus
GGPPATATGPAVGSSDSPDPDPLPDVTDGSRPSGARPAGPNPNGVPQRRLLHTYPD

SEQ ID NO: 5693 - protein, 56 aa, Hepatitis E virus
ENGEPSVKLYTSVEAAQLDQGVTIPHDIDLGLSTVTPQDFDNQHLQDRPTPSPAPA

SEQ ID NO: 5694 - protein, 56 aa, Hepatitis E virus
SAWRDQAQRPAAASRRRPTTAGAAPLTAVAPAHDTPPVPDVDSRGAILRRQYNLST

SEQ ID NO: 5695 - protein, 56 aa, Hepatitis E virus
ASSVHLLGDPNQIPAIDFEHAGLVPAIRPELVPTKWWHLTHRCPADVCELIRGAYP

SEQ ID NO: 5696 - protein, 56 aa, Eastern equine encephalitis virus
TLTSNDLYANTNLKLQRPQPGVVHTPYTQAPSGFERWKKDRGAPLNDIAPFGCTIA

SEQ ID NO: 5697 - protein, 56 aa, Eastern equine encephalitis virus
SLKTRPAAPHKVPTIGVYGVPGSGKSGIIKSAVTKRDLVVSAKKENCTEIIKDVKR

SEQ ID NO: 5698 - protein, 56 aa, Eastern equine encephalitis virus
QAPSGFERWKKDRGAPLNDIAPFGCTIALDPLRAENCAVGNIPLSIDIPDAAFTRI

SEQ ID NO: 5699 - protein, 56 aa, Eastern equine encephalitis virus
KVSIPLLSTGIYAGGKDRVMQSLNHLFTAMDTTDADVTIYCLDKQWEARIKDAIAR

SEQ ID NO: 5700 - protein, 56 aa, Eastern equine encephalitis virus
KCVKKADAGPMCLVGELVDPPFHEFAYESLKTRPAAPHKVPTIGVYGVPGSGKSGI

SEQ ID NO: 5701 - protein, 56 aa, Betapapillomavirus 2
SSTPVQRAVQSLSSLRRALYNRRLTEQVAVTDPLFLSRPSQLVQFQFDNPAFEEEV

SEQ ID NO: 5702 - protein, 56 aa, Betapapillomavirus 2
IETAQESFEMQSWPSRYSFEIEEGTPPRSSTPVQRAVQSLSSLRRALYNRRLTEQV

SEQ ID NO: 5703 - protein, 56 aa, Betapapillomavirus 2
TASSENIELQEFPSRYSFEIDEGTPPRTSTPVQRAVQSLSSLRRALYNRRLTEQVA

SEQ ID NO: 5704 - protein, 56 aa, Betapapillomavirus 2
STPVQRAVQSLSSLRRALYNRRLTEQVAVTDPLFLSRPSRLVQFQFDNPAFEDEVT

SEQ ID NO: 5705 - protein, 56 aa, Betapapillomavirus 2
STPVQRAVQSLSSLRRALYNRRLTEQVAVTDPLFLGRPSRLVQFQFDNPTFEEEVT

SEQ ID NO: 5706 - protein, 45 aa, Betapapillomavirus 2
TDQSWKSFFKRLWTQLDLSDQEDEGEDGNSQRTFQCTARDFNGPV

SEQ ID NO: 5707 - protein, 56 aa, Betapapillomavirus 2
MSDDKGTYDPKEGCSDWFVLEAECSDASLDGDLEKLFEEGTDTDISDLIDNEDTVQ

SEQ ID NO: 5708 - protein, 56 aa, Betapapillomavirus 2
TSTPVQRAVESLSSLRRALYNRRLTEQVAVTDPLFLSRPSRLVQFQFDNPAFEEEV

SEQ ID NO: 5709 - protein, 56 aa, Betapapillomavirus 2
LSSQEVLQLSPRLQSITISPQHKSKRRLFERDSGLELSFNEAEDLTQQTLEVQEVS

SEQ ID NO: 5710 - protein, 56 aa, Hepatitis A virus
EEDKRFESHIECRKPYKELRLEVGKQRLKYAQEELSNEVLPPPRKMKGLFSQAKIS

SEQ ID NO: 5711 - protein, 56 aa, Hepatitis A virus
EEDRRFESHIECRKPYKELRLEVGKQRLKYAQEELSNEVLPPPRKMKGLFSQAKIS

SEQ ID NO: 5712 - protein, 56 aa, Hepatitis A virus
EEDRRFESHIESRKPYKELRLEVGKQRLKYAQEELSNEVLPPPRKMKGLFSQAKIS

SEQ ID NO: 5713 - protein, 52 aa, Hepatitis A virus
SVDDPRTEEDRKFESHIEKRKPYKELRLEVGKQRLKYAQEELSNEVLPPPRK

SEQ ID NO: 5714 - protein, 33 aa, Hepatitis A virus
LEVGKQRLKYAQEELSNEVLPPPRKMKGLFSQS

SEQ ID NO: 5715 - protein, 56 aa, Hepatitis A virus
SSVDDPRSEEDRRFESHIECRKPYKELRLEVGKQRLKYAQEELSNEVLPPPRKMKG

SEQ ID NO: 5716 - protein, 56 aa, Hepatitis A virus
EEDRKFESHIEKRKPYKELRLEVGKQRLKYAQEELSNEVLPPPRKIKGVFSQAKIS

SEQ ID NO: 5717 - protein, 56 aa, Hepatitis A virus
TNAMMSSETMMDRIALGDLESSVDDPRSEEDRKFESHIEKRKPYKELRLEVGKQRL

SEQ ID NO: 5718 - protein, 56 aa, Hepatitis A virus
SNAMLSTESMMSRIAAGDLESSVDDPRSEEDKRFESHIECRKPYKELRLEVGKQRL

SEQ ID NO: 5719 - protein, 56 aa, Hepatitis A virus
LADVEEEQMIQSVDRTAVTGASYFTSVDQSSVHTAEVGSHQPEPLKTSVDKPGSKR

SEQ ID NO: 5720 - protein, 56 aa, Hepatitis A virus
TNAMMSSETMLDRIALGDLESSVDDPRSEEDRKFESHIEKRKPYKELRLEVGKQRL

SEQ ID NO: 5721 - protein, 56 aa, Hepatitis A virus
EEDRRFESHIECRKPYKELRLEVGKQRLKYAQEELSNEVLPPPRKMKGVFSQAKIS

SEQ ID NO: 5722 - protein, 56 aa, Hepatitis A virus
YFPRAPLNSNAMLSTESMMSRIAAGDLESSVDDPRSEEDRRFESHIECRKPYKELR

SEQ ID NO: 5723 - protein, 56 aa, Hepatitis A virus
FSRKEEEPIPAEGVYHGVTKPKQVIKLDADPVESQSTLEIAGLVRKNLVQFGVGEK

SEQ ID NO: 5724 - protein, 56 aa, Hepatitis A virus
SNAMLSTETMMSRIAAGDLESSVDDPRSEEDRRFESHIESRKPYKELRLEVGKQRL

SEQ ID NO: 5725 - protein, 56 aa, Hepatitis A virus
FPRAPLNTNAMMSSETVMDRIALGDLESSVDDPRTEEDRKFESHIEKRKPYKELRL

SEQ ID NO: 5726 - protein, 56 aa, Hepatitis A virus
EEDKRFESHIECRKPYKELRLEVGKQRLKYAQEELSNEVLPPPRKKKGLFSQAKIS

SEQ ID NO: 5727 - protein, 56 aa, Bat coronavirus 1B
RHNKTIRGSFINGACGSPGFNINGDTVEFVYLHQLELGSGCHVGSNMEGAMYGGFE

SEQ ID NO: 5728 - protein, 56 aa, Bat coronavirus 1B
CIAARDVVVTNLNKSAGYPLNKFGKAGLYYEALSYEEQDALYAVTKRNILPTMTQL

SEQ ID NO: 5729 - protein, 56 aa, Bat coronavirus 1B
QNNEVIPGKLNVRPVKGEGDGGFTADGKALFNNEGGKTFMYAFIADKPDLKVVKWE

SEQ ID NO: 5730 - protein, 56 aa, Chikungunya virus
FQSLSESATMVYNEREFVNRKLHHIAMHGPALNTDEESYELVRAERTEHEYVYDVD

SEQ ID NO: 5731 - protein, 56 aa, Chikungunya virus
SGRAGRYAVEAYDGRVLVPSGYAISPEDFQSLSESATMVYNEREFVNRKLHHIAMH

SEQ ID NO: 5732 - protein, 56 aa, Chikungunya virus
SCEGYVVKRITMSPGLYGKTTGYAVTHHADGFLMCKTTDTVDGERVSFSVCTYVPA

SEQ ID NO: 5733 - protein, 56 aa, Chikungunya virus
YQLLQASLTCSPHRQRRSTKDNFNVYKATRPYLAHCPDCGEGHSCHSPVALERIRN

SEQ ID NO: 5734 - protein, 56 aa, Orf virus
RRRRVTTVVEEGDPVCSSCNSRLVSIKDVDRLSTLSLGLACSSTLSCAACGSALTP

SEQ ID NO: 5735 - protein, 56 aa, Orf virus
YMSEYRSAMSKLIWLSATKSSSSVREDTFRAMASPCSRKAFRRTTPLTSILEYAAE

SEQ ID NO: 5736 - protein, 56 aa, Orf virus
PASSSPMPMATGVKAVTSSQMRRSRNPTLEEGCAAGGEVMRAGTRLGAGSGGELRS

SEQ ID NO: 5737 - protein, 56 aa, Orf virus
LGQCGERRHTGKPTALRQRTMVESSIQQPASSSPMPMATGVKAVTSSQMRRSRNPT

SEQ ID NO: 5738 - protein, 56 aa, Orf virus
SRATASLSARGSSASVSASAAEASASAPAASAWQRFSTTSSQFRRRPRTAPTRTAQ

SEQ ID NO: 5739 - protein, 56 aa, Orf virus
TSTYPSLDSDSIARRCASLLATTSSATRRWKAKSGTASGVGASETCGTWYLPNHCT

SEQ ID NO: 5740 - protein, 56 aa, Orf virus
CPCDEAEQEIDQEQLPVPETVPEPPAKTPKRRPVKKDKADKADKDKSTRGAKKPCP

SEQ ID NO: 5741 - protein, 47 aa, Orf virus
VLVPVRRVVSVRRAVPVGGVSALFRGAAVVVERARTASRHQVAVQRH

SEQ ID NO: 5742 - protein, 56 aa, Orf virus
CPCDEAEQEIDQEQLPVPETVPEPPAKTPKRRPVKKDKADKADKDKSTRGAKKPCL

SEQ ID NO: 5743 - protein, 56 aa, Alphapapillomavirus 7
STTSFAFFKYSPTISSASSYSNVTVPLTSSWDVPVYTGPDITLPSTTSVWPIVSPT

SEQ ID NO: 5744 - protein, 56 aa, Alphapapillomavirus 7
ICVQAERETAQALFNVQEAQRDAREMHVLKRKFGCSIENSSEKAAAGKKAKSPLQE

SEQ ID NO: 5745 - protein, 56 aa, Alphapapillomavirus 7
PLVSATEDNDLFDIYADDMDPAVPVPSRSTTSFAFFKYSPTISSASSYSNVTVPLT

SEQ ID NO: 5746 - protein, 56 aa, Measles virus
AVGFVPDTGPASRSVIRSIIKSSRIEEDRKRYLMTLLDDIKGANDLAKFHQMLMKI

SEQ ID NO: 5747 - protein, 49 aa, Measles virus
TASESSQDPQDSRRSAEALLRLQAMAGISEEQGSDTDTPRVYNDRDLLD

SEQ ID NO: 5748 - protein, 49 aa, Measles virus
TAPESSQDPQDSRRSADALLRLQAMAGISEEQGSDTDTPTVHNDRNLLD

SEQ ID NO: 5749 - protein, 56 aa, Measles virus
HGDQSENELPRLGGKEDRRVKQSRGEARESYRETGPSRASDARAAHLPTGTPPDTD

SEQ ID NO: 5750 - protein, 49 aa, Measles virus
TATESSQDPQDSRRSADALLRLQAMAGISEEQGSDTDTPIVYNDRNLLD

SEQ ID NO: 5751 - protein, 49 aa, Measles virus
TASESSQDPQDSRRSADALLRLQAMAGISEEQGSDTDTPIVYNDRNLLD

SEQ ID NO: 5752 - protein, 56 aa, Measles virus
ESYRETGPSRASDARAAHLPTDTPLDIDTASESSQDPQDSRRSAEALLRLQAMAGI

SEQ ID NO: 5753 - protein, 56 aa, Measles virus
HGDQSENELPRLGGKEDRRVKQSRGEARESYRETGPSRASDARAAHLPTGTPLDID

SEQ ID NO: 5754 - protein, 56 aa, Measles virus
ESYRETGPSRASDARAAHLPTGTPLDIDTASESSQDPQDSRRSADALLRLQAMAGI

SEQ ID NO: 5755 - protein, 56 aa, Measles virus
ESYRETGPSRASDARAAHLPTGTPLDIDTATESSQDPQDSRRSADALLRLQAMAGI

SEQ ID NO: 5756 - protein, 56 aa, Measles virus
HGDQSENEPPRWGGKEDMRVKQSRGEARESYRETGPSRASDARAAHLPTDTPLDID

SEQ ID NO: 5757 - protein, 56 aa, Measles virus
ESYRETGPSRASDARAAHLPTGTPLDIDTASESSQDPQDSRRSAEPLLSCKPWQES

SEQ ID NO: 5758 - protein, 56 aa, Measles virus
ESYRETGPSRASDARAAHLPTGTPPDTDTAPESSQDPQDSRRSADALLRLQAMAGI

SEQ ID NO: 5759 - protein, 56 aa, Measles virus
QGDQSENELPRLGGKEDRRVKQSRGEARESYRETGPSRASDARAAHLPTGTPLDID

SEQ ID NO: 5760 - protein, 56 aa, Alphapapillomavirus 2
QVVPPLSVTKAKARNAIEVHVALQQLQESAYAHEPWTLRDTSREMWDTAPKGCWKK

SEQ ID NO: 5761 - protein, 56 aa, Alphapapillomavirus 2
PMETFASPGTGNEPISSTPVPGVSRIAGPRLYAKAVTQVKVTDPAFLSRPTSLVTF

SEQ ID NO: 5762 - protein, 56 aa, Alphapapillomavirus 2
LGVGLSGHPLYNKLDDTENSNIAHGDIGKDSRDNISVDNKQTQLCIVGCTPPMGEH

SEQ ID NO: 5763 - protein, 56 aa, Alphapapillomavirus 3
PRLGLYTKATQQVPVADPAFVSRPASFATFDNPIYDPEETIIFEHPSIYTPPDPDF

SEQ ID NO: 5764 - protein, 56 aa, Alphapapillomavirus 3
MVTFASNAGTGSEPISSTPLPGVRRVAGPRLGLYTKATQQVPVADPAFVSRPASFA

SEQ ID NO: 5765 - protein, 56 aa, Alphapapillomavirus 3
YKCPLDDKGDPVYQFNNENWKSFFQRSWAQIEGTPEEEEEEEEEDNGNTGRPFRCV

SEQ ID NO: 5766 - protein, 56 aa, Alphapapillomavirus 3
HKCPLKSNGDPVYTLNNENWKSFFQRSWARIEGPDEQEEEEDEDGSTSRPFRCVPG

SEQ ID NO: 5767 - protein, 48 aa, Human parainfluenza virus 1
IDIENKIARRLADRKQRLNQANNKRDISSDADYENDDDATAAAEIGGI

SEQ ID NO: 5768 - protein, 56 aa, Human parainfluenza virus 1
TSEDSSNLEDHNTKTSPKVLPSKNEESVATQKNNHNHRKTKYTTNNANNNTKSLPT

SEQ ID NO: 5769 - protein, 56 aa, Human parainfluenza virus 1
ATPKNNHNHRKTKYTMNNANNNTKSPPTPEHDTTANEEETSNTSVDEMAKLLVSLG

SEQ ID NO: 5770 - protein, 56 aa, Human parainfluenza virus 1
WMNHSTNNHTITIHGAEELEEETNDEDIIDIENKIARRLADRKQRLNQANNKRDIS

SEQ ID NO: 5771 - protein, 38 aa, Variola virus
KVERCCCAVFTDWPESWYMDTSGIKKYSPDEWVSSIKF

SEQ ID NO: 5772 - protein, 56 aa, Variola virus
RIAIVNYANLNGSPLSVEDLDVCSEDEIDRIYKTIKQYHESRKRKIIVTNVIIIVI

SEQ ID NO: 5773 - protein, 47 aa, Human immunodeficiency virus 2
RKQWRRDHWRGLRVAREDHRSLKQGGSEPSAPRAHFPGVAKVLEILA

SEQ ID NO: 5774 - protein, 48 aa, Macacine herpesvirus 1
AAGAAPPIAEAGETEAVGALVNASAATHVDVDVGRAADLFVSQMMGGR

SEQ ID NO: 5775 - protein, 56 aa, Macacine herpesvirus 1
TRFALYKEVRLALASRSDAASSTPVPPGCVDAEYSRTRDCPDGRTPGIWNEPRIRR

SEQ ID NO: 5776 - protein, 56 aa, Macacine herpesvirus 1
YRDGYASGEPWPGAEPPPPGRVLYGGLGDSRPGLWGAPEVDEARRRYEAAGAPAPV

SEQ ID NO: 5777 - protein, 56 aa, Macacine herpesvirus 1
PASPGAKRALADAAARASARKKSRLYPVYVVDADPRVSPSPPPSPGGPVDPEPGSA

SEQ ID NO: 5778 - protein, 56 aa, Macacine herpesvirus 1
SDDLTDAPLVLGGERVDSLGALRRLVAGAARDPAPRAAPPTTLYYTRMDGAPPRLP

SEQ ID NO: 5779 - protein, 56 aa, Macacine herpesvirus 1
GAEEGGERPGEKEKEERPEGAVGAEPDAPASPGAKRALADAAARASARKKSRLYPV

SEQ ID NO: 5780 - protein, 56 aa, Tanapox virus
KDNPLYEPLNNNKLTRKNAIRRKMLRPNDKNQIVLPFNNNNNNNNNKIGIGNANAN

SEQ ID NO: 5781 - protein, 56 aa, Tanapox virus
YTTAISLSNRLKINKKKINQQLYKLQKEDTVKMVPSNPPKWFKNYNCDNGEKHDSK

SEQ ID NO: 5782 - protein, 54 aa, Hepatitis delta virus
FLAPPSKVTGGGARNTGDQWSHGMPFPMLDSDSPPKGRPGMAGPHSAGSAFHPL

SEQ ID NO: 5783 - protein, 56 aa, Human picobirnavirus
FDIVQKGQPEEYRTTFAKGSSVQDVLQDWEPILNQISDKWPSLVEFENDLKAKVGP

SEQ ID NO: 5784 - protein, 56 aa, Human picobirnavirus
FGDMGDGTYQQYLNHGYSTYAMCAVLGWRGQEGGPEPDDVKQRVVWMMPLALNVAE

SEQ ID NO: 5785 - protein, 56 aa, Alphapapillomavirus 8
PATATTETVGPAQAPPRKRRRNGHLPITTTVGKSLGGEYVDTADRTRTPDPESNNG

SEQ ID NO: 5786 - protein, 56 aa, Alphapapillomavirus 8
STVEGLPIVAPVDIRHPAATDATDATKVHDAPYALPASTTKVYNDSHAPPRKRRRD

SEQ ID NO: 5787 - protein, 56 aa, Alphapapillomavirus 8
STIEEHGLPIVETADARPPTTATDTPDAPATATTETVGPAQAPPRKRRRNGHLPIT

SEQ ID NO: 5788 - protein, 56 aa, Alphapapillomavirus 8
VEFHKEARTYGETGQWNVVMGSNVIYSPASVSSTVSEVSSVASTESDTGPATTVPD

SEQ ID NO: 5789 - protein, 45 aa, Alphapapillomavirus 13
NKNWKSFFKRSWSRLALNDNDNEEEENGDPSNTFRCVPGKASRPI

SEQ ID NO: 5790 - protein, 56 aa, Alphapapillomavirus 11
RLVTYDNPAFEGLQDTTLEFQHSDLHNAPDSDFLDIVKLHRPALTARKTGIRVSRL

SEQ ID NO: 5791 - protein, 56 aa, Alphapapillomavirus 11
FLNPFPFDSNGNPLYQLTNENWKAFFTKTWSKLDLTEDDDKENDGDTVQTFKCVSG

SEQ ID NO: 5792 - protein, 56 aa, Pseudocowpox virus
DSSVSSNEIAEAINAALKTRYVRDTSNVVNSALSIASARSEKQLDAVKRATCCISA

SEQ ID NO: 5793 - protein, 56 aa, Marburg marburgvirus
LHSKGADNAELNYVSCALDRKIVQKHPSDNRLAWTIGNRAPYIGSRTEDKIGYPPL

SEQ ID NO: 5794 - protein, 56 aa, Marburg marburgvirus
KHDQRYEKKESSQQQMSPEDNMQTLAYMHNSSPSQTFIKSIDVHEDFDASRVILNS

SEQ ID NO: 5795 - protein, 56 aa, Rabies virus
TEAETYTNFVGYVTTTFKRKHFRPTPDACRAAYNWKMAGDPRYEESLHNPYPDYRW

SEQ ID NO: 5796 - protein, 56 aa, Rabies virus
ELQEYETAELTKTDVALADDGTVNSDDEDYFSGETRSPEAVYSRIMMNGGRLKRSH

SEQ ID NO: 5797 - protein, 56 aa, Dengue virus
QTGSASSMVNGVVRLLTKPWDVVPMVTQMAMTDTTPFGQQRVFKEKVDTRTQEPKE

SEQ ID NO: 5798 - protein, 56 aa, Dengue virus
ETKQTGSASSMVNGVVRLLTKPWDVIPMVTQMAMTDTTPFGQQRVFKEKVDTRTQE

SEQ ID NO: 5799 - protein, 56 aa, Dengue virus
ETKQTGSASSMGNGVVRLLTKPWDVVPMVTQMAMTDTTPFGQQRVFKEKVDTRTQE

SEQ ID NO: 5800 - protein, 56 aa, Dengue virus
EKIKQEHETSWHYDQDHPYKTWAYHGSYETKQTGSASSMVNGVVRLLTKPWDVVPM

SEQ ID NO: 5801 - protein, 56 aa, Dengue virus
ETKQTGSASSMVNGVVRLLTKPWDVVPMVTQMAMTDTTPFGQQRVFKEKVDTRTQE

SEQ ID NO: 5802 - protein, 56 aa, Dengue virus
KATGSASSMINGVVKLLTKPWDVVPMVTQMAMTDTTPFGQQRVFKEKVDTRTPRPM

SEQ ID NO: 5803 - protein, 56 aa, Dengue virus
EKIKQEHETSWHYDQDHPYKTWAYHGSYETKQTGSASSMGNGVVRLLTKPWDVVPM

SEQ ID NO: 5804 - protein, 56 aa, Severe acute respiratory syndrome-related coronavirus
NTPKDHIGTRNPNNNAATVLQLPQGTTLPKGFYAEGSRGGSQASSRSSSRSRGNSR

SEQ ID NO: 5805 - protein, 56 aa, Lagos bat virus
MSKGLIHPSSIRSGLVDLEMAEETVDLVHKNLTDGQAHLQGEPFSVDSLPEDVRRM

SEQ ID NO: 5806 - protein, 56 aa, Lagos bat virus
TDNKQTQTDPLNLPKPLPKANPVQKEEQSKPGPTGGRVKPKIPPKSEWAKTTEEVS

SEQ ID NO: 5807 - protein, 56 aa, Lagos bat virus
SKPGPTGGRVKPKIPPKSEWAKTTEEVSDIEGEVAHQVAESFSKRYKFPSRSSGIF

SEQ ID NO: 5808 - protein, 56 aa, Alphapapillomavirus 1
MADDTGTEEGLGCSGWFCVEAIVDKTTENAISDDEDENVDDSGLDLVDFVDNSTVI

SEQ ID NO: 5809 - protein, 35 aa, Torque teno mini virus 1
TEDAGTQTHGEEKDYDLEEGDLDALFANDFEEDDG

SEQ ID NO: 5810 - protein, 56 aa, Human coronavirus 229E
GENEEIIINGHTYVCAWLTKRKPLDYKRQNNLAIEEIEYVHGDALHTLRNGSVLEM

SEQ ID NO: 5811 - protein, 55 aa, Human papillomavirus
CTPCIGEHWDKAIPCEKERQDNRLCPPIELKTTYIEDGDMADIGFGNLNFKNLQE

SEQ ID NO: 5812 - protein, 38 aa, Human papillomavirus
PTPDNAVHDTYRYISSKATKCPDAVPETQKEDPFGQYT

The invention claimed is:

1. A method for detecting an antibody against a pathogen in a subject, the method comprising:
    (a) contacting a reaction sample comprising a display library with a biological sample comprising antibodies, wherein the display library comprises a plurality of peptides derived from a plurality of pathogens, wherein the display library is constructed using a synthetic, programmable microarray from a starting library that is uniformly distributed, and
    (b) detecting a peptide bound to at least one antibody, thereby detecting an antibody capable of binding the peptide.

2. The method of claim 1, wherein the plurality of pathogens is a plurality of viruses, bacteria or fungi.

3. The method of claim 1, wherein the display library is a phage display library.

4. The method of claim 1, wherein the antibodies in the reaction sample are immobilized.

5. The method of claim 1, wherein each peptide of the plurality of peptides comprises a common adapter region appended to the end of the nucleic acid sequence encoding the peptide.

* * * * *